United States Patent 11,464,842 (COMPOSITIONS AND METHOD FOR OPTIMIZED PEPTIDE VACCINES USING RESIDUE OPTIMIZATION) - sequence listing, part 42

SEQ ID NO: 341875 - protein, 15 aa, Artificial Sequence
  Description of Artificial Sequence: Synthetic peptide
  Seed: WLGVSRQLRTKAWNR (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNR

SEQ ID NO: 341876 - protein, 15 aa, Artificial Sequence
  Description of Artificial Sequence: Synthetic peptide
  Seed: WLGVSRQLRTKAWNR (PMEL_HUMAN)
  Core: SRQLRTKAW
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLGVXRQXRXKAXNR

SEQ ID NO: 341877 - protein, 16 aa, Artificial Sequence
  Description of Artificial Sequence: Synthetic peptide
  Seed: WLGVSRQLRTKAWNRQ (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQ

SEQ ID NO: 341878 - protein, 16 aa, Artificial Sequence
  Description of Artificial Sequence: Synthetic peptide
  Seed: WLGVSRQLRTKAWNRQ (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRX

SEQ ID NO: 341879 - protein, 17 aa, Artificial Sequence
  Description of Artificial Sequence: Synthetic peptide
  Seed: WLGVSRQLRTKAWNRQL (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQL

SEQ ID NO: 341880 - protein, 17 aa, Artificial Sequence
  Description of Artificial Sequence: Synthetic peptide
  Seed: WLGVSRQLRTKAWNRQL (PMEL_HUMAN)
  Core: QLRTKAWNR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRXLRXKXWNXQL

SEQ ID NO: 341881 - protein, 17 aa, Artificial Sequence
  Description of Artificial Sequence: Synthetic peptide
  Seed: WLGVSRQLRTKAWNRQL (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXL

SEQ ID NO: 341882 - protein, 18 aa, Artificial Sequence
  Description of Artificial Sequence: Synthetic peptide
  Seed: WLGVSRQLRTKAWNRQLY (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLY

SEQ ID NO: 341883 - protein, 19 aa, Artificial Sequence
  Description of Artificial Sequence: Synthetic peptide
  Seed: WLGVSRQLRTKAWNRQLYP (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYP

SEQ ID NO: 341884 - protein, 19 aa, Artificial Sequence
  Description of Artificial Sequence: Synthetic peptide
  Seed: WLGVSRQLRTKAWNRQLYP (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYP

SEQ ID NO: 341885 - protein, 19 aa, Artificial Sequence
  Description of Artificial Sequence: Synthetic peptide
  Seed: WLGVSRQLRTKAWNRQLYP (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXP

SEQ ID NO: 341886 - protein, 20 aa, Artificial Sequence
  Description of Artificial Sequence: Synthetic peptide
  Seed: WLGVSRQLRTKAWNRQLYPE (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPE

SEQ ID NO: 341887 - protein, 20 aa, Artificial Sequence
  Description of Artificial Sequence: Synthetic peptide
  Seed: WLGVSRQLRTKAWNRQLYPE (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPE

SEQ ID NO: 341888 - protein, 20 aa, Artificial Sequence
  Description of Artificial Sequence: Synthetic peptide
  Seed: WLGVSRQLRTKAWNRQLYPE (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPE

SEQ ID NO: 341889 - protein, 21 aa, Artificial Sequence
  Description of Artificial Sequence: Synthetic peptide
  Seed: WLGVSRQLRTKAWNRQLYPEW (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPEW

SEQ ID NO: 341890 - protein, 21 aa, Artificial Sequence
  Description of Artificial Sequence: Synthetic peptide
  Seed: WLGVSRQLRTKAWNRQLYPEW (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPEW

SEQ ID NO: 341891 - protein, 21 aa, Artificial Sequence
  Description of Artificial Sequence: Synthetic peptide
  Seed: WLGVSRQLRTKAWNRQLYPEW (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPEW

SEQ ID NO: 341892 - protein, 22 aa, Artificial Sequence
  Description of Artificial Sequence: Synthetic peptide
  Seed: WLGVSRQLRTKAWNRQLYPEWT (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPEWT

SEQ ID NO: 341893 - protein, 22 aa, Artificial Sequence
  Description of Artificial Sequence: Synthetic peptide
  Seed: WLGVSRQLRTKAWNRQLYPEWT (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPEWT

SEQ ID NO: 341894 - protein, 22 aa, Artificial Sequence
  Description of Artificial Sequence: Synthetic peptide
  Seed: WLGVSRQLRTKAWNRQLYPEWT (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPEWT

SEQ ID NO: 341895 - protein, 23 aa, Artificial Sequence
  Description of Artificial Sequence: Synthetic peptide
  Seed: WLGVSRQLRTKAWNRQLYPEWTE (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPEWTE

SEQ ID NO: 341896 - protein, 23 aa, Artificial Sequence
  Description of Artificial Sequence: Synthetic peptide
  Seed: WLGVSRQLRTKAWNRQLYPEWTE (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPEWTE

SEQ ID NO: 341897 - protein, 23 aa, Artificial Sequence
  Description of Artificial Sequence: Synthetic peptide
  Seed: WLGVSRQLRTKAWNRQLYPEWTE (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPEWTE

SEQ ID NO: 341898 - protein, 24 aa, Artificial Sequence
  Description of Artificial Sequence: Synthetic peptide
  Seed: WLGVSRQLRTKAWNRQLYPEWTEA (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPEWTEA

SEQ ID NO: 341899 - protein, 24 aa, Artificial Sequence
  Description of Artificial Sequence: Synthetic peptide
  Seed: WLGVSRQLRTKAWNRQLYPEWTEA (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPEWTEA

SEQ ID NO: 341900 - protein, 24 aa, Artificial Sequence
  Description of Artificial Sequence: Synthetic peptide
  Seed: WLGVSRQLRTKAWNRQLYPEWTEA (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPEWTEA

SEQ ID NO: 341901 - protein, 24 aa, Artificial Sequence
  Description of Artificial Sequence: Synthetic peptide
  Seed: WLGVSRQLRTKAWNRQLYPEWTEA (PMEL_HUMAN)
  Core: NRQLYPEWT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRTKAWXRQXYXEWXEA

SEQ ID NO: 341902 - protein, 25 aa, Artificial Sequence
  Description of Artificial Sequence: Synthetic peptide
  Seed: WLGVSRQLRTKAWNRQLYPEWTEAQ (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWNRQLYPEWTEAQ

SEQ ID NO: 341903 - protein, 25 aa, Artificial Sequence
  Description of Artificial Sequence: Synthetic peptide
  Seed: WLGVSRQLRTKAWNRQLYPEWTEAQ (PMEL_HUMAN)
  Core: LRTKAWNRQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQXRTXAXNRXLYPEWTEAQ

SEQ ID NO: 341904 - protein, 25 aa, Artificial Sequence
  Description of Artificial Sequence: Synthetic peptide
  Seed: WLGVSRQLRTKAWNRQLYPEWTEAQ (PMEL_HUMAN)
  Core: TKAWNRQLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRXKAXNXQLXPEWTEAQ

SEQ ID NO: 341905 - protein, 25 aa, Artificial Sequence
  Description of Artificial Sequence: Synthetic peptide
  Seed: WLGVSRQLRTKAWNRQLYPEWTEAQ (PMEL_HUMAN)
  Core: NRQLYPEWT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WLGVSRQLRTKAWXRQXYXEWXEAQ

SEQ ID NO: 341906 - protein, 14 aa, Artificial Sequence
  Description of Artificial Sequence: Synthetic peptide
  Seed: WLRLPRIFCSCPIG (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXG

SEQ ID NO: 341907 - protein, 15 aa, Artificial Sequence
  Description of Artificial Sequence: Synthetic peptide
  Seed: WLRLPRIFCSCPIGE (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGE

SEQ ID NO: 341908 - protein, 15 aa, Artificial Sequence
  Description of Artificial Sequence: Synthetic peptide
  Seed: WLRLPRIFCSCPIGE (PMEL_HUMAN)
  Core: RIFCSCPIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPXIFXSXPIXE

SEQ ID NO: 341909 - protein, 16 aa, Artificial Sequence
  Description of Artificial Sequence: Synthetic peptide
  Seed: WLRLPRIFCSCPIGEN (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGEN

SEQ ID NO: 341910 - protein, 16 aa, Artificial Sequence
  Description of Artificial Sequence: Synthetic peptide
  Seed: WLRLPRIFCSCPIGEN (PMEL_HUMAN)
  Core: RIFCSCPIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPXIFXSXPIXEN

SEQ ID NO: 341911 - protein, 16 aa, Artificial Sequence
  Description of Artificial Sequence: Synthetic peptide
  Seed: WLRLPRIFCSCPIGEN (PMEL_HUMAN)
  Core: IFCSCPIGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRXFCXCXIGXN

SEQ ID NO: 341912 - protein, 17 aa, Artificial Sequence
  Description of Artificial Sequence: Synthetic peptide
  Seed: WLRLPRIFCSCPIGENS (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENS

SEQ ID NO: 341913 - protein, 17 aa, Artificial Sequence
  Description of Artificial Sequence: Synthetic peptide
  Seed: WLRLPRIFCSCPIGENS (PMEL_HUMAN)
  Core: RIFCSCPIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPXIFXSXPIXENS

SEQ ID NO: 341914 - protein, 17 aa, Artificial Sequence
  Description of Artificial Sequence: Synthetic peptide
  Seed: WLRLPRIFCSCPIGENS (PMEL_HUMAN)
  Core: IFCSCPIGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRXFCXCXIGXNS

SEQ ID NO: 341915 - protein, 17 aa, Artificial Sequence
  Description of Artificial Sequence: Synthetic peptide
  Seed: WLRLPRIFCSCPIGENS (PMEL_HUMAN)
  Core: FCSCPIGEN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIXCSXPXGEXS

SEQ ID NO: 341916 - protein, 19 aa, Artificial Sequence
  Description of Artificial Sequence: Synthetic peptide
  Seed: WLRLPRIFCSCPIGENSPL (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENSPL

SEQ ID NO: 341917 - protein, 19 aa, Artificial Sequence
  Description of Artificial Sequence: Synthetic peptide
  Seed: WLRLPRIFCSCPIGENSPL (PMEL_HUMAN)
  Core: FCSCPIGEN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIXCSXPXGEXSPL

SEQ ID NO: 341918 - protein, 20 aa, Artificial Sequence
  Description of Artificial Sequence: Synthetic peptide
  Seed: WLRLPRIFCSCPIGENSPLL (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENSPLL

SEQ ID NO: 341919 - protein, 20 aa, Artificial Sequence
  Description of Artificial Sequence: Synthetic peptide
  Seed: WLRLPRIFCSCPIGENSPLL (PMEL_HUMAN)
  Core: IFCSCPIGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRXFCXCXIGXNSPLL

SEQ ID NO: 341920 - protein, 20 aa, Artificial Sequence
  Description of Artificial Sequence: Synthetic peptide
  Seed: WLRLPRIFCSCPIGENSPLL (PMEL_HUMAN)
  Core: FCSCPIGEN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIXCSXPXGEXSPLL

SEQ ID NO: 341921 - protein, 21 aa, Artificial Sequence
  Description of Artificial Sequence: Synthetic peptide
  Seed: WLRLPRIFCSCPIGENSPLLS (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENSPLLS

SEQ ID NO: 341922 - protein, 22 aa, Artificial Sequence
  Description of Artificial Sequence: Synthetic peptide
  Seed: WLRLPRIFCSCPIGENSPLLSG (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENSPLLSG

SEQ ID NO: 341923 - protein, 23 aa, Artificial Sequence
  Description of Artificial Sequence: Synthetic peptide
  Seed: WLRLPRIFCSCPIGENSPLLSGQ (PMEL_HUMAN)
  Core: PRIFCSCPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WLRLXRIXCXCPXGENSPLLSGQ

SEQ ID NO: 341924 - protein, 23 aa, Artificial Sequence
  Description of Artificial Sequence: Synthetic peptide
  Seed: WLRLPRIFCSCPIGENSPLLSGQ (PMEL_HUMAN)
  Core: FCSCPIGEN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIXCSXPXGEXSPLLSGQ

SEQ ID NO: 341925 - protein, 24 aa, Artificial Sequence
  Description of Artificial Sequence: Synthetic peptide
  Seed: WLRLPRIFCSCPIGENSPLLSGQQ (PMEL_HUMAN)
  Core: IGENSPLLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIFCSCPXGEXSXLLXGQQ

SEQ ID NO: 341926 - protein, 25 aa, Artificial Sequence
  Description of Artificial Sequence: Synthetic peptide
  Seed: WLRLPRIFCSCPIGENSPLLSGQQV (PMEL_HUMAN)
  Core: IGENSPLLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WLRLPRIFCSCPXGEXSXLLXGQQV

SEQ ID NO: 341927 - protein, 15 aa, Artificial Sequence
  Description of Artificial Sequence: Synthetic peptide
  Seed: WNRQLYPEWTEAQRL (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRL

SEQ ID NO: 341928 - protein, 16 aa, Artificial Sequence
  Description of Artificial Sequence: Synthetic peptide
  Seed: WNRQLYPEWTEAQRLD (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRLD

SEQ ID NO: 341929 - protein, 20 aa, Artificial Sequence
  Description of Artificial Sequence: Synthetic peptide
  Seed: WNRQLYPEWTEAQRLDCWRG (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRLDCWRG

SEQ ID NO: 341930 - protein, 23 aa, Artificial Sequence
  Description of Artificial Sequence: Synthetic peptide
  Seed: WNRQLYPEWTEAQRLDCWRGGQV (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRLDCWRGGQV

SEQ ID NO: 341931 - protein, 24 aa, Artificial Sequence
  Description of Artificial Sequence: Synthetic peptide
  Seed: WNRQLYPEWTEAQRLDCWRGGQVS (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRLDCWRGGQVS

SEQ ID NO: 341932 - protein, 25 aa, Artificial Sequence
  Description of Artificial Sequence: Synthetic peptide
  Seed: WNRQLYPEWTEAQRLDCWRGGQVSL (PMEL_HUMAN)
  Core: LYPEWTEAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WNRQXYPXWXEAXRLDCWRGGQVSL

SEQ ID NO: 341933 - protein, 13 aa, Artificial Sequence
  Description of Artificial Sequence: Synthetic peptide
  Seed: WQVLGGPVSGLSI (PMEL_HUMAN)
  Core: VLGGPVSGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WQXLGXPXSGXSI

SEQ ID NO: 341934 - protein, 14 aa, Artificial Sequence
  Description of Artificial Sequence: Synthetic peptide
  Seed: WQVLGGPVSGLSIG (PMEL_HUMAN)
  Core: VLGGPVSGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WQXLGXPXSGXSIG

SEQ ID NO: 341935 - protein, 15 aa, Artificial Sequence
  Description of Artificial Sequence: Synthetic peptide
  Seed: WQVLGGPVSGLSIGT (PMEL_HUMAN)
  Core: VLGGPVSGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WQXLGXPXSGXSIGT

SEQ ID NO: 341936 - protein, 15 aa, Artificial Sequence
  Description of Artificial Sequence: Synthetic peptide
  Seed: WQVLGGPVSGLSIGT (PMEL_HUMAN)
  Core: LGGPVSGLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WQVXGGXVXGLXIGT

SEQ ID NO: 341937 - protein, 15 aa, Artificial Sequence
  Description of Artificial Sequence: Synthetic peptide
  Seed: WQVLGGPVSGLSIGT (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGX

SEQ ID NO: 341938 - protein, 16 aa, Artificial Sequence
  Description of Artificial Sequence: Synthetic peptide
  Seed: WQVLGGPVSGLSIGTG (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXG

SEQ ID NO: 341939 - protein, 16 aa, Artificial Sequence
  Description of Artificial Sequence: Synthetic peptide
  Seed: WQVLGGPVSGLSIGTG (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTX

SEQ ID NO: 341940 - protein, 17 aa, Artificial Sequence
  Description of Artificial Sequence: Synthetic peptide
  Seed: WQVLGGPVSGLSIGTGR (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGR

SEQ ID NO: 341941 - protein, 17 aa, Artificial Sequence
  Description of Artificial Sequence: Synthetic peptide
  Seed: WQVLGGPVSGLSIGTGR (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXR

SEQ ID NO: 341942 - protein, 18 aa, Artificial Sequence
  Description of Artificial Sequence: Synthetic peptide
  Seed: WQVLGGPVSGLSIGTGRA (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGRA

SEQ ID NO: 341943 - protein, 19 aa, Artificial Sequence
  Description of Artificial Sequence: Synthetic peptide
  Seed: WQVLGGPVSGLSIGTGRAM (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGRAM

SEQ ID NO: 341944 - protein, 19 aa, Artificial Sequence
  Description of Artificial Sequence: Synthetic peptide
  Seed: WQVLGGPVSGLSIGTGRAM (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAM

SEQ ID NO: 341945 - protein, 20 aa, Artificial Sequence
  Description of Artificial Sequence: Synthetic peptide
  Seed: WQVLGGPVSGLSIGTGRAML (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGRAML

SEQ ID NO: 341946 - protein, 20 aa, Artificial Sequence
  Description of Artificial Sequence: Synthetic peptide
  Seed: WQVLGGPVSGLSIGTGRAML (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAML

SEQ ID NO: 341947 - protein, 20 aa, Artificial Sequence
  Description of Artificial Sequence: Synthetic peptide
  Seed: WQVLGGPVSGLSIGTGRAML (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXL

SEQ ID NO: 341948 - protein, 21 aa, Artificial Sequence
  Description of Artificial Sequence: Synthetic peptide
  Seed: WQVLGGPVSGLSIGTGRAMLG (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGRAMLG

SEQ ID NO: 341949 - protein, 21 aa, Artificial Sequence
  Description of Artificial Sequence: Synthetic peptide
  Seed: WQVLGGPVSGLSIGTGRAMLG (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAMLG

SEQ ID NO: 341950 - protein, 21 aa, Artificial Sequence
  Description of Artificial Sequence: Synthetic peptide
  Seed: WQVLGGPVSGLSIGTGRAMLG (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXLG

SEQ ID NO: 341951 - protein, 22 aa, Artificial Sequence
  Description of Artificial Sequence: Synthetic peptide
  Seed: WQVLGGPVSGLSIGTGRAMLGT (PMEL_HUMAN)
  Core: PVSGLSIGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGXVSXLXIGXGRAMLGT

SEQ ID NO: 341952 - protein, 22 aa, Artificial Sequence
  Description of Artificial Sequence: Synthetic peptide
  Seed: WQVLGGPVSGLSIGTGRAMLGT (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAMLGT

SEQ ID NO: 341953 - protein, 22 aa, Artificial Sequence
  Description of Artificial Sequence: Synthetic peptide
  Seed: WQVLGGPVSGLSIGTGRAMLGT (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXLGT

SEQ ID NO: 341954 - protein, 22 aa, Artificial Sequence
  Description of Artificial Sequence: Synthetic peptide
  Seed: WQVLGGPVSGLSIGTGRAMLGT (PMEL_HUMAN)
  Core: IGTGRAMLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGLSXGTXRXMLXT

SEQ ID NO: 341955 - protein, 23 aa, Artificial Sequence
  Description of Artificial Sequence: Synthetic peptide
  Seed: WQVLGGPVSGLSIGTGRAMLGTH (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAMLGTH

SEQ ID NO: 341956 - protein, 23 aa, Artificial Sequence
  Description of Artificial Sequence: Synthetic peptide
  Seed: WQVLGGPVSGLSIGTGRAMLGTH (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXLGTH

SEQ ID NO: 341957 - protein, 23 aa, Artificial Sequence
  Description of Artificial Sequence: Synthetic peptide
  Seed: WQVLGGPVSGLSIGTGRAMLGTH (PMEL_HUMAN)
  Core: IGTGRAMLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGLSXGTXRXMLXTH

SEQ ID NO: 341958 - protein, 24 aa, Artificial Sequence
  Description of Artificial Sequence: Synthetic peptide
  Seed: WQVLGGPVSGLSIGTGRAMLGTHT (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAMLGTHT

SEQ ID NO: 341959 - protein, 24 aa, Artificial Sequence
  Description of Artificial Sequence: Synthetic peptide
  Seed: WQVLGGPVSGLSIGTGRAMLGTHT (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXLGTHT

SEQ ID NO: 341960 - protein, 24 aa, Artificial Sequence
  Description of Artificial Sequence: Synthetic peptide
  Seed: WQVLGGPVSGLSIGTGRAMLGTHT (PMEL_HUMAN)
  Core: IGTGRAMLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGLSXGTXRXMLXTHT

SEQ ID NO: 341961 - protein, 25 aa, Artificial Sequence
  Description of Artificial Sequence: Synthetic peptide
  Seed: WQVLGGPVSGLSIGTGRAMLGTHTM (PMEL_HUMAN)
  Core: VSGLSIGTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPXSGXSXGTXRAMLGTHTM

SEQ ID NO: 341962 - protein, 25 aa, Artificial Sequence
  Description of Artificial Sequence: Synthetic peptide
  Seed: WQVLGGPVSGLSIGTGRAMLGTHTM (PMEL_HUMAN)
  Core: LSIGTGRAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGXSIXTXRAXLGTHTM

SEQ ID NO: 341963 - protein, 25 aa, Artificial Sequence
  Description of Artificial Sequence: Synthetic peptide
  Seed: WQVLGGPVSGLSIGTGRAMLGTHTM (PMEL_HUMAN)
  Core: IGTGRAMLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WQVLGGPVSGLSXGTXRXMLXTHTM

SEQ ID NO: 341964 - protein, 15 aa, Artificial Sequence
  Description of Artificial Sequence: Synthetic peptide
  Seed: WRGGQVSLKVSNDGP (PMEL_HUMAN)
  Core: QVSLKVSND
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WRGGXVSXKXSNXGP

SEQ ID NO: 341965 - protein, 20 aa, Artificial Sequence
  Description of Artificial Sequence: Synthetic peptide
  Seed: WRGGQVSLKVSNDGPTLIGA (PMEL_HUMAN)
  Core: LKVSNDGPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSXKVXNXGPXLIGA

SEQ ID NO: 341966 - protein, 20 aa, Artificial Sequence
  Description of Artificial Sequence: Synthetic peptide
  Seed: WRGGQVSLKVSNDGPTLIGA (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGA

SEQ ID NO: 341967 - protein, 21 aa, Artificial Sequence
  Description of Artificial Sequence: Synthetic peptide
  Seed: WRGGQVSLKVSNDGPTLIGAN (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGAN

SEQ ID NO: 341968 - protein, 22 aa, Artificial Sequence
  Description of Artificial Sequence: Synthetic peptide
  Seed: WRGGQVSLKVSNDGPTLIGANA (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGANA

SEQ ID NO: 341969 - protein, 23 aa, Artificial Sequence
  Description of Artificial Sequence: Synthetic peptide
  Seed: WRGGQVSLKVSNDGPTLIGANAS (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGANAS

SEQ ID NO: 341970 - protein, 24 aa, Artificial Sequence
  Description of Artificial Sequence: Synthetic peptide
  Seed: WRGGQVSLKVSNDGPTLIGANASF (PMEL_HUMAN)
  Core: LKVSNDGPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSXKVXNXGPXLIGANASF

SEQ ID NO: 341971 - protein, 24 aa, Artificial Sequence
  Description of Artificial Sequence: Synthetic peptide
  Seed: WRGGQVSLKVSNDGPTLIGANASF (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGANASF

SEQ ID NO: 341972 - protein, 24 aa, Artificial Sequence
  Description of Artificial Sequence: Synthetic peptide
  Seed: WRGGQVSLKVSNDGPTLIGANASF (PMEL_HUMAN)
  Core: PTLIGANAS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKVSNDGXTLXGXNAXF

SEQ ID NO: 341973 - protein, 25 aa, Artificial Sequence
  Description of Artificial Sequence: Synthetic peptide
  Seed: WRGGQVSLKVSNDGPTLIGANASFS (PMEL_HUMAN)
  Core: LKVSNDGPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSXKVXNXGPXLIGANASFS

SEQ ID NO: 341974 - protein, 25 aa, Artificial Sequence
  Description of Artificial Sequence: Synthetic peptide
  Seed: WRGGQVSLKVSNDGPTLIGANASFS (PMEL_HUMAN)
  Core: VSNDGPTLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKXSNXGXTLXGANASFS

SEQ ID NO: 341975 - protein, 25 aa, Artificial Sequence
  Description of Artificial Sequence: Synthetic peptide
  Seed: WRGGQVSLKVSNDGPTLIGANASFS (PMEL_HUMAN)
  Core: PTLIGANAS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKVSNDGXTLXGXNAXFS

SEQ ID NO: 341976 - protein, 25 aa, Artificial Sequence
  Description of Artificial Sequence: Synthetic peptide
  Seed: WRGGQVSLKVSNDGPTLIGANASFS (PMEL_HUMAN)
  Core: LIGANASFS
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
WRGGQVSLKVSNDGPTXIGXNXSFX

SEQ ID NO: 341977 - protein, 14 aa, Artificial Sequence
  Description of Artificial Sequence: Synthetic peptide
  Seed: WSQKRSFVYVWKTW (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXW

SEQ ID NO: 341978 - protein, 15 aa, Artificial Sequence
  Description of Artificial Sequence: Synthetic peptide
  Seed: WSQKRSFVYVWKTWG (PMEL_HUMAN)
  Core: KRSFVYVWK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WSQXRSXVXVWXTWG

SEQ ID NO: 341979 - protein, 15 aa, Artificial Sequence
  Description of Artificial Sequence: Synthetic peptide
  Seed: WSQKRSFVYVWKTWG (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWG

SEQ ID NO: 341980 - protein, 15 aa, Artificial Sequence
  Description of Artificial Sequence: Synthetic peptide
  Seed: WSQKRSFVYVWKTWG (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWX

SEQ ID NO: 341981 - protein, 16 aa, Artificial Sequence
  Description of Artificial Sequence: Synthetic peptide
  Seed: WSQKRSFVYVWKTWGQ (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQ

SEQ ID NO: 341982 - protein, 16 aa, Artificial Sequence
  Description of Artificial Sequence: Synthetic peptide
  Seed: WSQKRSFVYVWKTWGQ (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQ

SEQ ID NO: 341983 - protein, 16 aa, Artificial Sequence
  Description of Artificial Sequence: Synthetic peptide
  Seed: WSQKRSFVYVWKTWGQ (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGX

SEQ ID NO: 341984 - protein, 17 aa, Artificial Sequence
  Description of Artificial Sequence: Synthetic peptide
  Seed: WSQKRSFVYVWKTWGQY (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQY

SEQ ID NO: 341985 - protein, 17 aa, Artificial Sequence
  Description of Artificial Sequence: Synthetic peptide
  Seed: WSQKRSFVYVWKTWGQY (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQY

SEQ ID NO: 341986 - protein, 17 aa, Artificial Sequence
  Description of Artificial Sequence: Synthetic peptide
  Seed: WSQKRSFVYVWKTWGQY (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXY

SEQ ID NO: 341987 - protein, 17 aa, Artificial Sequence
  Description of Artificial Sequence: Synthetic peptide
  Seed: WSQKRSFVYVWKTWGQY (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQX

SEQ ID NO: 341988 - protein, 18 aa, Artificial Sequence
  Description of Artificial Sequence: Synthetic peptide
  Seed: WSQKRSFVYVWKTWGQYW (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYW

SEQ ID NO: 341989 - protein, 18 aa, Artificial Sequence
  Description of Artificial Sequence: Synthetic peptide
  Seed: WSQKRSFVYVWKTWGQYW (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYW

SEQ ID NO: 341990 - protein, 18 aa, Artificial Sequence
  Description of Artificial Sequence: Synthetic peptide
  Seed: WSQKRSFVYVWKTWGQYW (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYW

SEQ ID NO: 341991 - protein, 18 aa, Artificial Sequence
  Description of Artificial Sequence: Synthetic peptide
  Seed: WSQKRSFVYVWKTWGQYW (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXW

SEQ ID NO: 341992 - protein, 19 aa, Artificial Sequence
  Description of Artificial Sequence: Synthetic peptide
  Seed: WSQKRSFVYVWKTWGQYWQ (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQ

SEQ ID NO: 341993 - protein, 19 aa, Artificial Sequence
  Description of Artificial Sequence: Synthetic peptide
  Seed: WSQKRSFVYVWKTWGQYWQ (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQ

SEQ ID NO: 341994 - protein, 19 aa, Artificial Sequence
  Description of Artificial Sequence: Synthetic peptide
  Seed: WSQKRSFVYVWKTWGQYWQ (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQ

SEQ ID NO: 341995 - protein, 19 aa, Artificial Sequence
  Description of Artificial Sequence: Synthetic peptide
  Seed: WSQKRSFVYVWKTWGQYWQ (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQ

SEQ ID NO: 341996 - protein, 20 aa, Artificial Sequence
  Description of Artificial Sequence: Synthetic peptide
  Seed: WSQKRSFVYVWKTWGQYWQV (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQV

SEQ ID NO: 341997 - protein, 20 aa, Artificial Sequence
  Description of Artificial Sequence: Synthetic peptide
  Seed: WSQKRSFVYVWKTWGQYWQV (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQV

SEQ ID NO: 341998 - protein, 20 aa, Artificial Sequence
  Description of Artificial Sequence: Synthetic peptide
  Seed: WSQKRSFVYVWKTWGQYWQV (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQV

SEQ ID NO: 341999 - protein, 20 aa, Artificial Sequence
  Description of Artificial Sequence: Synthetic peptide
  Seed: WSQKRSFVYVWKTWGQYWQV (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQV

SEQ ID NO: 342000 - protein, 21 aa, Artificial Sequence
  Description of Artificial Sequence: Synthetic peptide
  Seed: WSQKRSFVYVWKTWGQYWQVL (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQVL

SEQ ID NO: 342001 - protein, 21 aa, Artificial Sequence
  Description of Artificial Sequence: Synthetic peptide
  Seed: WSQKRSFVYVWKTWGQYWQVL (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQVL

SEQ ID NO: 342002 - protein, 21 aa, Artificial Sequence
  Description of Artificial Sequence: Synthetic peptide
  Seed: WSQKRSFVYVWKTWGQYWQVL (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQVL

SEQ ID NO: 342003 - protein, 21 aa, Artificial Sequence
  Description of Artificial Sequence: Synthetic peptide
  Seed: WSQKRSFVYVWKTWGQYWQVL (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQVL

SEQ ID NO: 342004 - protein, 22 aa, Artificial Sequence
  Description of Artificial Sequence: Synthetic peptide
  Seed: WSQKRSFVYVWKTWGQYWQVLG (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQVLG

SEQ ID NO: 342005 - protein, 22 aa, Artificial Sequence
  Description of Artificial Sequence: Synthetic peptide
  Seed: WSQKRSFVYVWKTWGQYWQVLG (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQVLG

SEQ ID NO: 342006 - protein, 22 aa, Artificial Sequence
  Description of Artificial Sequence: Synthetic peptide
  Seed: WSQKRSFVYVWKTWGQYWQVLG (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQVLG

SEQ ID NO: 342007 - protein, 22 aa, Artificial Sequence
  Description of Artificial Sequence: Synthetic peptide
  Seed: WSQKRSFVYVWKTWGQYWQVLG (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQVLG

SEQ ID NO: 342008 - protein, 23 aa, Artificial Sequence
  Description of Artificial Sequence: Synthetic peptide
  Seed: WSQKRSFVYVWKTWGQYWQVLGG (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQVLGG

SEQ ID NO: 342009 - protein, 23 aa, Artificial Sequence
  Description of Artificial Sequence: Synthetic peptide
  Seed: WSQKRSFVYVWKTWGQYWQVLGG (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQVLGG

SEQ ID NO: 342010 - protein, 23 aa, Artificial Sequence
  Description of Artificial Sequence: Synthetic peptide
  Seed: WSQKRSFVYVWKTWGQYWQVLGG (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQVLGG

SEQ ID NO: 342011 - protein, 23 aa, Artificial Sequence
  Description of Artificial Sequence: Synthetic peptide
  Seed: WSQKRSFVYVWKTWGQYWQVLGG (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQVLGG

SEQ ID NO: 342012 - protein, 24 aa, Artificial Sequence
  Description of Artificial Sequence: Synthetic peptide
  Seed: WSQKRSFVYVWKTWGQYWQVLGGP (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQVLGGP

SEQ ID NO: 342013 - protein, 24 aa, Artificial Sequence
  Description of Artificial Sequence: Synthetic peptide
  Seed: WSQKRSFVYVWKTWGQYWQVLGGP (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQVLGGP

SEQ ID NO: 342014 - protein, 24 aa, Artificial Sequence
  Description of Artificial Sequence: Synthetic peptide
  Seed: WSQKRSFVYVWKTWGQYWQVLGGP (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQVLGGP

SEQ ID NO: 342015 - protein, 24 aa, Artificial Sequence
  Description of Artificial Sequence: Synthetic peptide
  Seed: WSQKRSFVYVWKTWGQYWQVLGGP (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQVLGGP

SEQ ID NO: 342016 - protein, 24 aa, Artificial Sequence
  Description of Artificial Sequence: Synthetic peptide
  Seed: WSQKRSFVYVWKTWGQYWQVLGGP (PMEL_HUMAN)
  Core: TWGQYWQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVYVWKXWGXYXQVXGGP

SEQ ID NO: 342017 - protein, 25 aa, Artificial Sequence
  Description of Artificial Sequence: Synthetic peptide
  Seed: WSQKRSFVYVWKTWGQYWQVLGGPV (PMEL_HUMAN)
  Core: RSFVYVWKT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WSQKXSFXYXWKXWGQYWQVLGGPV

SEQ ID NO: 342018 - protein, 25 aa, Artificial Sequence
  Description of Artificial Sequence: Synthetic peptide
  Seed: WSQKRSFVYVWKTWGQYWQVLGGPV (PMEL_HUMAN)
  Core: FVYVWKTWG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSXVYXWXTWXQYWQVLGGPV

SEQ ID NO: 342019 - protein, 25 aa, Artificial Sequence
  Description of Artificial Sequence: Synthetic peptide
  Seed: WSQKRSFVYVWKTWGQYWQVLGGPV (PMEL_HUMAN)
  Core: VYVWKTWGQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFXYVXKXWGXYWQVLGGPV

SEQ ID NO: 342020 - protein, 25 aa, Artificial Sequence
  Description of Artificial Sequence: Synthetic peptide
  Seed: WSQKRSFVYVWKTWGQYWQVLGGPV (PMEL_HUMAN)
  Core: YVWKTWGQY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVXVWXTXGQXWQVLGGPV

SEQ ID NO: 342021 - protein, 25 aa, Artificial Sequence
  Description of Artificial Sequence: Synthetic peptide
  Seed: WSQKRSFVYVWKTWGQYWQVLGGPV (PMEL_HUMAN)
  Core: TWGQYWQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVYVWKXWGXYXQVXGGPV

SEQ ID NO: 342022 - protein, 25 aa, Artificial Sequence
  Description of Artificial Sequence: Synthetic peptide
  Seed: WSQKRSFVYVWKTWGQYWQVLGGPV (PMEL_HUMAN)
  Core: YWQVLGGPV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
WSQKRSFVYVWKTWGQXWQXLXGPX

SEQ ID NO: 342023 - protein, 19 aa, Artificial Sequence
  Description of Artificial Sequence: Synthetic peptide
  Seed: WTEAQRLDCWRGGQVSLKV (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXV

SEQ ID NO: 342024 - protein, 20 aa, Artificial Sequence
  Description of Artificial Sequence: Synthetic peptide
  Seed: WTEAQRLDCWRGGQVSLKVS (PMEL_HUMAN)
  Core: LDCWRGGQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRXDCXRXGQXSLKVS

SEQ ID NO: 342025 - protein, 20 aa, Artificial Sequence
  Description of Artificial Sequence: Synthetic peptide
  Seed: WTEAQRLDCWRGGQVSLKVS (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVS

SEQ ID NO: 342026 - protein, 21 aa, Artificial Sequence
  Description of Artificial Sequence: Synthetic peptide
  Seed: WTEAQRLDCWRGGQVSLKVSN (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVSN

SEQ ID NO: 342027 - protein, 22 aa, Artificial Sequence
  Description of Artificial Sequence: Synthetic peptide
  Seed: WTEAQRLDCWRGGQVSLKVSND (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVSND

SEQ ID NO: 342028 - protein, 23 aa, Artificial Sequence
  Description of Artificial Sequence: Synthetic peptide
  Seed: WTEAQRLDCWRGGQVSLKVSNDG (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVSNDG

SEQ ID NO: 342029 - protein, 24 aa, Artificial Sequence
  Description of Artificial Sequence: Synthetic peptide
  Seed: WTEAQRLDCWRGGQVSLKVSNDGP (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVSNDGP

SEQ ID NO: 342030 - protein, 25 aa, Artificial Sequence
  Description of Artificial Sequence: Synthetic peptide
  Seed: WTEAQRLDCWRGGQVSLKVSNDGPT (PMEL_HUMAN)
  Core: WRGGQVSLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WTEAQRLDCXRGXQXSLXVSNDGPT

SEQ ID NO: 342031 - protein, 14 aa, Artificial Sequence
  Description of Artificial Sequence: Synthetic peptide
  Seed: WVNNTIINGSQVWG (PMEL_HUMAN)
  Core: VNNTIINGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
WXNNXIXNGXQVWG

SEQ ID NO: 342032 - protein, 15 aa, Artificial Sequence
  Description of Artificial Sequence: Synthetic peptide
  Seed: WVNNTIINGSQVWGG (PMEL_HUMAN)
  Core: NTIINGSQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVNXTIXNXSQXWGG

SEQ ID NO: 342033 - protein, 15 aa, Artificial Sequence
  Description of Artificial Sequence: Synthetic peptide
  Seed: WVNNTIINGSQVWGG (PMEL_HUMAN)
  Core: TIINGSQVW
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WVNNXIIXGXQVXGG

SEQ ID NO: 342034 - protein, 15 aa, Artificial Sequence
  Description of Artificial Sequence: Synthetic peptide
  Seed: WVNNTIINGSQVWGG (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGX

SEQ ID NO: 342035 - protein, 16 aa, Artificial Sequence
  Description of Artificial Sequence: Synthetic peptide
  Seed: WVNNTIINGSQVWGGQ (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQ

SEQ ID NO: 342036 - protein, 17 aa, Artificial Sequence
  Description of Artificial Sequence: Synthetic peptide
  Seed: WVNNTIINGSQVWGGQP (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQP

SEQ ID NO: 342037 - protein, 18 aa, Artificial Sequence
  Description of Artificial Sequence: Synthetic peptide
  Seed: WVNNTIINGSQVWGGQPV (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPV

SEQ ID NO: 342038 - protein, 19 aa, Artificial Sequence
  Description of Artificial Sequence: Synthetic peptide
  Seed: WVNNTIINGSQVWGGQPVY (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVY

SEQ ID NO: 342039 - protein, 20 aa, Artificial Sequence
  Description of Artificial Sequence: Synthetic peptide
  Seed: WVNNTIINGSQVWGGQPVYP (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYP

SEQ ID NO: 342040 - protein, 21 aa, Artificial Sequence
  Description of Artificial Sequence: Synthetic peptide
  Seed: WVNNTIINGSQVWGGQPVYPQ (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYPQ

SEQ ID NO: 342041 - protein, 22 aa, Artificial Sequence
  Description of Artificial Sequence: Synthetic peptide
  Seed: WVNNTIINGSQVWGGQPVYPQE (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYPQE

SEQ ID NO: 342042 - protein, 23 aa, Artificial Sequence
  Description of Artificial Sequence: Synthetic peptide
  Seed: WVNNTIINGSQVWGGQPVYPQET (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYPQET

SEQ ID NO: 342043 - protein, 23 aa, Artificial Sequence
  Description of Artificial Sequence: Synthetic peptide
  Seed: WVNNTIINGSQVWGGQPVYPQET (PMEL_HUMAN)
  Core: VWGGQPVYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIINGSQXWGXQXVYXQET

SEQ ID NO: 342044 - protein, 24 aa, Artificial Sequence
  Description of Artificial Sequence: Synthetic peptide
  Seed: WVNNTIINGSQVWGGQPVYPQETD (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYPQETD

SEQ ID NO: 342045 - protein, 24 aa, Artificial Sequence
  Description of Artificial Sequence: Synthetic peptide
  Seed: WVNNTIINGSQVWGGQPVYPQETD (PMEL_HUMAN)
  Core: VWGGQPVYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIINGSQXWGXQXVYXQETD

SEQ ID NO: 342046 - protein, 24 aa, Artificial Sequence
  Description of Artificial Sequence: Synthetic peptide
  Seed: WVNNTIINGSQVWGGQPVYPQETD (PMEL_HUMAN)
  Core: WGGQPVYPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIINGSQVXGGXPXYPXETD

SEQ ID NO: 342047 - protein, 25 aa, Artificial Sequence
  Description of Artificial Sequence: Synthetic peptide
  Seed: WVNNTIINGSQVWGGQPVYPQETDD (PMEL_HUMAN)
  Core: INGSQVWGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIXNGXQXWGXQPVYPQETDD

SEQ ID NO: 342048 - protein, 25 aa, Artificial Sequence
  Description of Artificial Sequence: Synthetic peptide
  Seed: WVNNTIINGSQVWGGQPVYPQETDD (PMEL_HUMAN)
  Core: VWGGQPVYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIINGSQXWGXQXVYXQETDD

SEQ ID NO: 342049 - protein, 25 aa, Artificial Sequence
  Description of Artificial Sequence: Synthetic peptide
  Seed: WVNNTIINGSQVWGGQPVYPQETDD (PMEL_HUMAN)
  Core: WGGQPVYPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WVNNTIINGSQVXGGXPXYPXETDD

SEQ ID NO: 342050 - protein, 14 aa, Artificial Sequence
  Description of Artificial Sequence: Synthetic peptide
  Seed: YCLNVSLADTNSLA (PMEL_HUMAN)
  Core: LNVSLADTN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YCXNVXLXDTXSLA

SEQ ID NO: 342051 - protein, 15 aa, Artificial Sequence
  Description of Artificial Sequence: Synthetic peptide
  Seed: YCLNVSLADTNSLAV (PMEL_HUMAN)
  Core: LNVSLADTN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YCXNVXLXDTXSLAV

SEQ ID NO: 342052 - protein, 15 aa, Artificial Sequence
  Description of Artificial Sequence: Synthetic peptide
  Seed: YCLNVSLADTNSLAV (PMEL_HUMAN)
  Core: NVSLADTNS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YCLXVSXAXTNXLAV

SEQ ID NO: 342053 - protein, 15 aa, Artificial Sequence
  Description of Artificial Sequence: Synthetic peptide
  Seed: YCLNVSLADTNSLAV (PMEL_HUMAN)
  Core: VSLADTNSL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YCLNXSLXDXNSXAV

SEQ ID NO: 342054 - protein, 15 aa, Artificial Sequence
  Description of Artificial Sequence: Synthetic peptide
  Seed: YCLNVSLADTNSLAV (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAX

SEQ ID NO: 342055 - protein, 16 aa, Artificial Sequence
  Description of Artificial Sequence: Synthetic peptide
  Seed: YCLNVSLADTNSLAVV (PMEL_HUMAN)
  Core: LNVSLADTN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YCXNVXLXDTXSLAVV

SEQ ID NO: 342056 - protein, 16 aa, Artificial Sequence
  Description of Artificial Sequence: Synthetic peptide
  Seed: YCLNVSLADTNSLAVV (PMEL_HUMAN)
  Core: NVSLADTNS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YCLXVSXAXTNXLAVV

SEQ ID NO: 342057 - protein, 16 aa, Artificial Sequence
  Description of Artificial Sequence: Synthetic peptide
  Seed: YCLNVSLADTNSLAVV (PMEL_HUMAN)
  Core: VSLADTNSL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YCLNXSLXDXNSXAVV

SEQ ID NO: 342058 - protein, 16 aa, Artificial Sequence
  Description of Artificial Sequence: Synthetic peptide
  Seed: YCLNVSLADTNSLAVV (PMEL_HUMAN)
  Core: SLADTNSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVXLAXTXSLXVV

SEQ ID NO: 342059 - protein, 16 aa, Artificial Sequence
  Description of Artificial Sequence: Synthetic peptide
  Seed: YCLNVSLADTNSLAVV (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXV

SEQ ID NO: 342060 - protein, 17 aa, Artificial Sequence
  Description of Artificial Sequence: Synthetic peptide
  Seed: YCLNVSLADTNSLAVVS (PMEL_HUMAN)
  Core: VSLADTNSL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YCLNXSLXDXNSXAVVS

SEQ ID NO: 342061 - protein, 17 aa, Artificial Sequence
  Description of Artificial Sequence: Synthetic peptide
  Seed: YCLNVSLADTNSLAVVS (PMEL_HUMAN)
  Core: SLADTNSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVXLAXTXSLXVVS

SEQ ID NO: 342062 - protein, 17 aa, Artificial Sequence
  Description of Artificial Sequence: Synthetic peptide
  Seed: YCLNVSLADTNSLAVVS (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVS

SEQ ID NO: 342063 - protein, 18 aa, Artificial Sequence
  Description of Artificial Sequence: Synthetic peptide
  Seed: YCLNVSLADTNSLAVVST (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVST

SEQ ID NO: 342064 - protein, 19 aa, Artificial Sequence
  Description of Artificial Sequence: Synthetic peptide
  Seed: YCLNVSLADTNSLAVVSTQ (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQ

SEQ ID NO: 342065 - protein, 19 aa, Artificial Sequence
  Description of Artificial Sequence: Synthetic peptide
  Seed: YCLNVSLADTNSLAVVSTQ (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQ

SEQ ID NO: 342066 - protein, 19 aa, Artificial Sequence
  Description of Artificial Sequence: Synthetic peptide
  Seed: YCLNVSLADTNSLAVVSTQ (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTX

SEQ ID NO: 342067 - protein, 20 aa, Artificial Sequence
  Description of Artificial Sequence: Synthetic peptide
  Seed: YCLNVSLADTNSLAVVSTQL (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQL

SEQ ID NO: 342068 - protein, 20 aa, Artificial Sequence
  Description of Artificial Sequence: Synthetic peptide
  Seed: YCLNVSLADTNSLAVVSTQL (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQL

SEQ ID NO: 342069 - protein, 20 aa, Artificial Sequence
  Description of Artificial Sequence: Synthetic peptide
  Seed: YCLNVSLADTNSLAVVSTQL (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXL

SEQ ID NO: 342070 - protein, 21 aa, Artificial Sequence
  Description of Artificial Sequence: Synthetic peptide
  Seed: YCLNVSLADTNSLAVVSTQLI (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQLI

SEQ ID NO: 342071 - protein, 21 aa, Artificial Sequence
  Description of Artificial Sequence: Synthetic peptide
  Seed: YCLNVSLADTNSLAVVSTQLI (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQLI

SEQ ID NO: 342072 - protein, 21 aa, Artificial Sequence
  Description of Artificial Sequence: Synthetic peptide
  Seed: YCLNVSLADTNSLAVVSTQLI (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXLI

SEQ ID NO: 342073 - protein, 22 aa, Artificial Sequence
  Description of Artificial Sequence: Synthetic peptide
  Seed: YCLNVSLADTNSLAVVSTQLIM (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQLIM

SEQ ID NO: 342074 - protein, 22 aa, Artificial Sequence
  Description of Artificial Sequence: Synthetic peptide
  Seed: YCLNVSLADTNSLAVVSTQLIM (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQLIM

SEQ ID NO: 342075 - protein, 22 aa, Artificial Sequence
  Description of Artificial Sequence: Synthetic peptide
  Seed: YCLNVSLADTNSLAVVSTQLIM (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXLIM

SEQ ID NO: 342076 - protein, 23 aa, Artificial Sequence
  Description of Artificial Sequence: Synthetic peptide
  Seed: YCLNVSLADTNSLAVVSTQLIMP (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQLIMP

SEQ ID NO: 342077 - protein, 23 aa, Artificial Sequence
  Description of Artificial Sequence: Synthetic peptide
  Seed: YCLNVSLADTNSLAVVSTQLIMP (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQLIMP

SEQ ID NO: 342078 - protein, 23 aa, Artificial Sequence
  Description of Artificial Sequence: Synthetic peptide
  Seed: YCLNVSLADTNSLAVVSTQLIMP (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXLIMP

SEQ ID NO: 342079 - protein, 23 aa, Artificial Sequence
  Description of Artificial Sequence: Synthetic peptide
  Seed: YCLNVSLADTNSLAVVSTQLIMP (PMEL_HUMAN)
  Core: LAVVSTQLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTNSXAVXSXQLXMP

SEQ ID NO: 342080 - protein, 24 aa, Artificial Sequence
  Description of Artificial Sequence: Synthetic peptide
  Seed: YCLNVSLADTNSLAVVSTQLIMPG (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQLIMPG

SEQ ID NO: 342081 - protein, 24 aa, Artificial Sequence
  Description of Artificial Sequence: Synthetic peptide
  Seed: YCLNVSLADTNSLAVVSTQLIMPG (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQLIMPG

SEQ ID NO: 342082 - protein, 24 aa, Artificial Sequence
  Description of Artificial Sequence: Synthetic peptide
  Seed: YCLNVSLADTNSLAVVSTQLIMPG (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXLIMPG

SEQ ID NO: 342083 - protein, 24 aa, Artificial Sequence
  Description of Artificial Sequence: Synthetic peptide
  Seed: YCLNVSLADTNSLAVVSTQLIMPG (PMEL_HUMAN)
  Core: LAVVSTQLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTNSXAVXSXQLXMPG

SEQ ID NO: 342084 - protein, 25 aa, Artificial Sequence
  Description of Artificial Sequence: Synthetic peptide
  Seed: YCLNVSLADTNSLAVVSTQLIMPGQ (PMEL_HUMAN)
  Core: LADTNSLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSXADXNXLAXVSTQLIMPGQ

SEQ ID NO: 342085 - protein, 25 aa, Artificial Sequence
  Description of Artificial Sequence: Synthetic peptide
  Seed: YCLNVSLADTNSLAVVSTQLIMPGQ (PMEL_HUMAN)
  Core: DTNSLAVVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLAXTNXLXVVXTQLIMPGQ

SEQ ID NO: 342086 - protein, 25 aa, Artificial Sequence
  Description of Artificial Sequence: Synthetic peptide
  Seed: YCLNVSLADTNSLAVVSTQLIMPGQ (PMEL_HUMAN)
  Core: NSLAVVSTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTXSLXVXSTXLIMPGQ

SEQ ID NO: 342087 - protein, 25 aa, Artificial Sequence
  Description of Artificial Sequence: Synthetic peptide
  Seed: YCLNVSLADTNSLAVVSTQLIMPGQ (PMEL_HUMAN)
  Core: LAVVSTQLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YCLNVSLADTNSXAVXSXQLXMPGQ

SEQ ID NO: 342088 - protein, 14 aa, Artificial Sequence
  Description of Artificial Sequence: Synthetic peptide
  Seed: YGSFSVTLDIVQGI (PMEL_HUMAN)
  Core: SFSVTLDIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YGXFSXTXDIXQGI

SEQ ID NO: 342089 - protein, 14 aa, Artificial Sequence
  Description of Artificial Sequence: Synthetic peptide
  Seed: YGSFSVTLDIVQGI (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGI

SEQ ID NO: 342090 - protein, 14 aa, Artificial Sequence
  Description of Artificial Sequence: Synthetic peptide
  Seed: YGSFSVTLDIVQGI (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGX

SEQ ID NO: 342091 - protein, 15 aa, Artificial Sequence
  Description of Artificial Sequence: Synthetic peptide
  Seed: YGSFSVTLDIVQGIE (PMEL_HUMAN)
  Core: SFSVTLDIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YGXFSXTXDIXQGIE

SEQ ID NO: 342092 - protein, 15 aa, Artificial Sequence
  Description of Artificial Sequence: Synthetic peptide
  Seed: YGSFSVTLDIVQGIE (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIE

SEQ ID NO: 342093 - protein, 15 aa, Artificial Sequence
  Description of Artificial Sequence: Synthetic peptide
  Seed: YGSFSVTLDIVQGIE (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXE

SEQ ID NO: 342094 - protein, 16 aa, Artificial Sequence
  Description of Artificial Sequence: Synthetic peptide
  Seed: YGSFSVTLDIVQGIES (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIES

SEQ ID NO: 342095 - protein, 16 aa, Artificial Sequence
  Description of Artificial Sequence: Synthetic peptide
  Seed: YGSFSVTLDIVQGIES (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXES

SEQ ID NO: 342096 - protein, 17 aa, Artificial Sequence
  Description of Artificial Sequence: Synthetic peptide
  Seed: YGSFSVTLDIVQGIESA (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIESA

SEQ ID NO: 342097 - protein, 17 aa, Artificial Sequence
  Description of Artificial Sequence: Synthetic peptide
  Seed: YGSFSVTLDIVQGIESA (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESA

SEQ ID NO: 342098 - protein, 17 aa, Artificial Sequence
  Description of Artificial Sequence: Synthetic peptide
  Seed: YGSFSVTLDIVQGIESA (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXA

SEQ ID NO: 342099 - protein, 18 aa, Artificial Sequence
  Description of Artificial Sequence: Synthetic peptide
  Seed: YGSFSVTLDIVQGIESAE (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAE

SEQ ID NO: 342100 - protein, 18 aa, Artificial Sequence
  Description of Artificial Sequence: Synthetic peptide
  Seed: YGSFSVTLDIVQGIESAE (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAE

SEQ ID NO: 342101 - protein, 19 aa, Artificial Sequence
  Description of Artificial Sequence: Synthetic peptide
  Seed: YGSFSVTLDIVQGIESAEI (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIESAEI

SEQ ID NO: 342102 - protein, 19 aa, Artificial Sequence
  Description of Artificial Sequence: Synthetic peptide
  Seed: YGSFSVTLDIVQGIESAEI (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEI

SEQ ID NO: 342103 - protein, 19 aa, Artificial Sequence
  Description of Artificial Sequence: Synthetic peptide
  Seed: YGSFSVTLDIVQGIESAEI (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEI

SEQ ID NO: 342104 - protein, 19 aa, Artificial Sequence
  Description of Artificial Sequence: Synthetic peptide
  Seed: YGSFSVTLDIVQGIESAEI (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEX

SEQ ID NO: 342105 - protein, 20 aa, Artificial Sequence
  Description of Artificial Sequence: Synthetic peptide
  Seed: YGSFSVTLDIVQGIESAEIL (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIESAEIL

SEQ ID NO: 342106 - protein, 20 aa, Artificial Sequence
  Description of Artificial Sequence: Synthetic peptide
  Seed: YGSFSVTLDIVQGIESAEIL (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEIL

SEQ ID NO: 342107 - protein, 20 aa, Artificial Sequence
  Description of Artificial Sequence: Synthetic peptide
  Seed: YGSFSVTLDIVQGIESAEIL (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEIL

SEQ ID NO: 342108 - protein, 20 aa, Artificial Sequence
  Description of Artificial Sequence: Synthetic peptide
  Seed: YGSFSVTLDIVQGIESAEIL (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXL

SEQ ID NO: 342109 - protein, 21 aa, Artificial Sequence
  Description of Artificial Sequence: Synthetic peptide
  Seed: YGSFSVTLDIVQGIESAEILQ (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEILQ

SEQ ID NO: 342110 - protein, 21 aa, Artificial Sequence
  Description of Artificial Sequence: Synthetic peptide
  Seed: YGSFSVTLDIVQGIESAEILQ (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEILQ

SEQ ID NO: 342111 - protein, 21 aa, Artificial Sequence
  Description of Artificial Sequence: Synthetic peptide
  Seed: YGSFSVTLDIVQGIESAEILQ (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXLQ

SEQ ID NO: 342112 - protein, 22 aa, Artificial Sequence
  Description of Artificial Sequence: Synthetic peptide
  Seed: YGSFSVTLDIVQGIESAEILQA (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEILQA

SEQ ID NO: 342113 - protein, 22 aa, Artificial Sequence
  Description of Artificial Sequence: Synthetic peptide
  Seed: YGSFSVTLDIVQGIESAEILQA (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEILQA

SEQ ID NO: 342114 - protein, 22 aa, Artificial Sequence
  Description of Artificial Sequence: Synthetic peptide
  Seed: YGSFSVTLDIVQGIESAEILQA (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXLQA

SEQ ID NO: 342115 - protein, 22 aa, Artificial Sequence
  Description of Artificial Sequence: Synthetic peptide
  Seed: YGSFSVTLDIVQGIESAEILQA (PMEL_HUMAN)
  Core: IESAEILQA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIVQGXESXEXLQX

SEQ ID NO: 342116 - protein, 23 aa, Artificial Sequence
  Description of Artificial Sequence: Synthetic peptide
  Seed: YGSFSVTLDIVQGIESAEILQAV (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEILQAV

SEQ ID NO: 342117 - protein, 23 aa, Artificial Sequence
  Description of Artificial Sequence: Synthetic peptide
  Seed: YGSFSVTLDIVQGIESAEILQAV (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEILQAV

SEQ ID NO: 342118 - protein, 23 aa, Artificial Sequence
  Description of Artificial Sequence: Synthetic peptide
  Seed: YGSFSVTLDIVQGIESAEILQAV (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXLQAV

SEQ ID NO: 342119 - protein, 23 aa, Artificial Sequence
  Description of Artificial Sequence: Synthetic peptide
  Seed: YGSFSVTLDIVQGIESAEILQAV (PMEL_HUMAN)
  Core: IESAEILQA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIVQGXESXEXLQXV

SEQ ID NO: 342120 - protein, 24 aa, Artificial Sequence
  Description of Artificial Sequence: Synthetic peptide
  Seed: YGSFSVTLDIVQGIESAEILQAVP (PMEL_HUMAN)
  Core: FSVTLDIVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YGSXSVXLXIVXGIESAEILQAVP

SEQ ID NO: 342121 - protein, 24 aa, Artificial Sequence
  Description of Artificial Sequence: Synthetic peptide
  Seed: YGSFSVTLDIVQGIESAEILQAVP (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEILQAVP

SEQ ID NO: 342122 - protein, 24 aa, Artificial Sequence
  Description of Artificial Sequence: Synthetic peptide
  Seed: YGSFSVTLDIVQGIESAEILQAVP (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEILQAVP

SEQ ID NO: 342123 - protein, 24 aa, Artificial Sequence
  Description of Artificial Sequence: Synthetic peptide
  Seed: YGSFSVTLDIVQGIESAEILQAVP (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXLQAVP

SEQ ID NO: 342124 - protein, 24 aa, Artificial Sequence
  Description of Artificial Sequence: Synthetic peptide
  Seed: YGSFSVTLDIVQGIESAEILQAVP (PMEL_HUMAN)
  Core: IESAEILQA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIVQGXESXEXLQXVP

SEQ ID NO: 342125 - protein, 25 aa, Artificial Sequence
  Description of Artificial Sequence: Synthetic peptide
  Seed: YGSFSVTLDIVQGIESAEILQAVPS (PMEL_HUMAN)
  Core: VTLDIVQGI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSXTLXIXQGXESAEILQAVPS

SEQ ID NO: 342126 - protein, 25 aa, Artificial Sequence
  Description of Artificial Sequence: Synthetic peptide
  Seed: YGSFSVTLDIVQGIESAEILQAVPS (PMEL_HUMAN)
  Core: LDIVQGIES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTXDIXQXIEXAEILQAVPS

SEQ ID NO: 342127 - protein, 25 aa, Artificial Sequence
  Description of Artificial Sequence: Synthetic peptide
  Seed: YGSFSVTLDIVQGIESAEILQAVPS (PMEL_HUMAN)
  Core: VQGIESAEI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIXQGXEXAEXLQAVPS

SEQ ID NO: 342128 - protein, 25 aa, Artificial Sequence
  Description of Artificial Sequence: Synthetic peptide
  Seed: YGSFSVTLDIVQGIESAEILQAVPS (PMEL_HUMAN)
  Core: IESAEILQA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YGSFSVTLDIVQGXESXEXLQXVPS

SEQ ID NO: 342129 - protein, 14 aa, Artificial Sequence
  Description of Artificial Sequence: Synthetic peptide
  Seed: YHRRGSRSYVPLAH (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAX

SEQ ID NO: 342130 - protein, 15 aa, Artificial Sequence
  Description of Artificial Sequence: Synthetic peptide
  Seed: YHRRGSRSYVPLAHS (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHS

SEQ ID NO: 342131 - protein, 15 aa, Artificial Sequence
  Description of Artificial Sequence: Synthetic peptide
  Seed: YHRRGSRSYVPLAHS (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXS

SEQ ID NO: 342132 - protein, 15 aa, Artificial Sequence
  Description of Artificial Sequence: Synthetic peptide
  Seed: YHRRGSRSYVPLAHS (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHX

SEQ ID NO: 342133 - protein, 16 aa, Artificial Sequence
  Description of Artificial Sequence: Synthetic peptide
  Seed: YHRRGSRSYVPLAHSS (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSS

SEQ ID NO: 342134 - protein, 16 aa, Artificial Sequence
  Description of Artificial Sequence: Synthetic peptide
  Seed: YHRRGSRSYVPLAHSS (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSS

SEQ ID NO: 342135 - protein, 16 aa, Artificial Sequence
  Description of Artificial Sequence: Synthetic peptide
  Seed: YHRRGSRSYVPLAHSS (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXS

SEQ ID NO: 342136 - protein, 17 aa, Artificial Sequence
  Description of Artificial Sequence: Synthetic peptide
  Seed: YHRRGSRSYVPLAHSSS (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSS

SEQ ID NO: 342137 - protein, 17 aa, Artificial Sequence
  Description of Artificial Sequence: Synthetic peptide
  Seed: YHRRGSRSYVPLAHSSS (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSS

SEQ ID NO: 342138 - protein, 17 aa, Artificial Sequence
  Description of Artificial Sequence: Synthetic peptide
  Seed: YHRRGSRSYVPLAHSSS (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSS

SEQ ID NO: 342139 - protein, 17 aa, Artificial Sequence
  Description of Artificial Sequence: Synthetic peptide
  Seed: YHRRGSRSYVPLAHSSS (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSX

SEQ ID NO: 342140 - protein, 18 aa, Artificial Sequence
  Description of Artificial Sequence: Synthetic peptide
  Seed: YHRRGSRSYVPLAHSSSA (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSSA

SEQ ID NO: 342141 - protein, 18 aa, Artificial Sequence
  Description of Artificial Sequence: Synthetic peptide
  Seed: YHRRGSRSYVPLAHSSSA (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSA

SEQ ID NO: 342142 - protein, 18 aa, Artificial Sequence
  Description of Artificial Sequence: Synthetic peptide
  Seed: YHRRGSRSYVPLAHSSSA (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXA

SEQ ID NO: 342143 - protein, 19 aa, Artificial Sequence
  Description of Artificial Sequence: Synthetic peptide
  Seed: YHRRGSRSYVPLAHSSSAF (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSSAF

SEQ ID NO: 342144 - protein, 19 aa, Artificial Sequence
  Description of Artificial Sequence: Synthetic peptide
  Seed: YHRRGSRSYVPLAHSSSAF (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAF

SEQ ID NO: 342145 - protein, 19 aa, Artificial Sequence
  Description of Artificial Sequence: Synthetic peptide
  Seed: YHRRGSRSYVPLAHSSSAF (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAF

SEQ ID NO: 342146 - protein, 19 aa, Artificial Sequence
  Description of Artificial Sequence: Synthetic peptide
  Seed: YHRRGSRSYVPLAHSSSAF (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAF

SEQ ID NO: 342147 - protein, 20 aa, Artificial Sequence
  Description of Artificial Sequence: Synthetic peptide
  Seed: YHRRGSRSYVPLAHSSSAFT (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSSAFT

SEQ ID NO: 342148 - protein, 20 aa, Artificial Sequence
  Description of Artificial Sequence: Synthetic peptide
  Seed: YHRRGSRSYVPLAHSSSAFT (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFT

SEQ ID NO: 342149 - protein, 20 aa, Artificial Sequence
  Description of Artificial Sequence: Synthetic peptide
  Seed: YHRRGSRSYVPLAHSSSAFT (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFT

SEQ ID NO: 342150 - protein, 20 aa, Artificial Sequence
  Description of Artificial Sequence: Synthetic peptide
  Seed: YHRRGSRSYVPLAHSSSAFT (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFT

SEQ ID NO: 342151 - protein, 20 aa, Artificial Sequence
  Description of Artificial Sequence: Synthetic peptide
  Seed: YHRRGSRSYVPLAHSSSAFT (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFX

SEQ ID NO: 342152 - protein, 21 aa, Artificial Sequence
  Description of Artificial Sequence: Synthetic peptide
  Seed: YHRRGSRSYVPLAHSSSAFTI (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSSAFTI

SEQ ID NO: 342153 - protein, 21 aa, Artificial Sequence
  Description of Artificial Sequence: Synthetic peptide
  Seed: YHRRGSRSYVPLAHSSSAFTI (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFTI

SEQ ID NO: 342154 - protein, 21 aa, Artificial Sequence
  Description of Artificial Sequence: Synthetic peptide
  Seed: YHRRGSRSYVPLAHSSSAFTI (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFTI

SEQ ID NO: 342155 - protein, 21 aa, Artificial Sequence
  Description of Artificial Sequence: Synthetic peptide
  Seed: YHRRGSRSYVPLAHSSSAFTI (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFTI

SEQ ID NO: 342156 - protein, 21 aa, Artificial Sequence
  Description of Artificial Sequence: Synthetic peptide
  Seed: YHRRGSRSYVPLAHSSSAFTI (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFXI

SEQ ID NO: 342157 - protein, 22 aa, Artificial Sequence
  Description of Artificial Sequence: Synthetic peptide
  Seed: YHRRGSRSYVPLAHSSSAFTIT (PMEL_HUMAN)
  Core: GSRSYVPLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YHRRXSRXYXPLXHSSSAFTIT

SEQ ID NO: 342158 - protein, 22 aa, Artificial Sequence
  Description of Artificial Sequence: Synthetic peptide
  Seed: YHRRGSRSYVPLAHSSSAFTIT (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFTIT

SEQ ID NO: 342159 - protein, 22 aa, Artificial Sequence
  Description of Artificial Sequence: Synthetic peptide
  Seed: YHRRGSRSYVPLAHSSSAFTIT (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFTIT

SEQ ID NO: 342160 - protein, 22 aa, Artificial Sequence
  Description of Artificial Sequence: Synthetic peptide
  Seed: YHRRGSRSYVPLAHSSSAFTIT (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFTIT

SEQ ID NO: 342161 - protein, 22 aa, Artificial Sequence
  Description of Artificial Sequence: Synthetic peptide
  Seed: YHRRGSRSYVPLAHSSSAFTIT (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFXIT

SEQ ID NO: 342162 - protein, 22 aa, Artificial Sequence
  Description of Artificial Sequence: Synthetic peptide
  Seed: YHRRGSRSYVPLAHSSSAFTIT (PMEL_HUMAN)
  Core: AHSSSAFTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPLXHSXSXFTXT

SEQ ID NO: 342163 - protein, 23 aa, Artificial Sequence
  Description of Artificial Sequence: Synthetic peptide
  Seed: YHRRGSRSYVPLAHSSSAFTITD (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFTITD

SEQ ID NO: 342164 - protein, 23 aa, Artificial Sequence
  Description of Artificial Sequence: Synthetic peptide
  Seed: YHRRGSRSYVPLAHSSSAFTITD (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFTITD

SEQ ID NO: 342165 - protein, 23 aa, Artificial Sequence
  Description of Artificial Sequence: Synthetic peptide
  Seed: YHRRGSRSYVPLAHSSSAFTITD (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFTITD

SEQ ID NO: 342166 - protein, 23 aa, Artificial Sequence
  Description of Artificial Sequence: Synthetic peptide
  Seed: YHRRGSRSYVPLAHSSSAFTITD (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFXITD

SEQ ID NO: 342167 - protein, 23 aa, Artificial Sequence
  Description of Artificial Sequence: Synthetic peptide
  Seed: YHRRGSRSYVPLAHSSSAFTITD (PMEL_HUMAN)
  Core: AHSSSAFTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPLXHSXSXFTXTD

SEQ ID NO: 342168 - protein, 24 aa, Artificial Sequence
  Description of Artificial Sequence: Synthetic peptide
  Seed: YHRRGSRSYVPLAHSSSAFTITDQ (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFTITDQ

SEQ ID NO: 342169 - protein, 24 aa, Artificial Sequence
  Description of Artificial Sequence: Synthetic peptide
  Seed: YHRRGSRSYVPLAHSSSAFTITDQ (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFTITDQ

SEQ ID NO: 342170 - protein, 24 aa, Artificial Sequence
  Description of Artificial Sequence: Synthetic peptide
  Seed: YHRRGSRSYVPLAHSSSAFTITDQ (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFTITDQ

SEQ ID NO: 342171 - protein, 24 aa, Artificial Sequence
  Description of Artificial Sequence: Synthetic peptide
  Seed: YHRRGSRSYVPLAHSSSAFTITDQ (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFXITDQ

SEQ ID NO: 342172 - protein, 24 aa, Artificial Sequence
  Description of Artificial Sequence: Synthetic peptide
  Seed: YHRRGSRSYVPLAHSSSAFTITDQ (PMEL_HUMAN)
  Core: AHSSSAFTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPLXHSXSXFTXTDQ

SEQ ID NO: 342173 - protein, 25 aa, Artificial Sequence
  Description of Artificial Sequence: Synthetic peptide
  Seed: YHRRGSRSYVPLAHSSSAFTITDQV (PMEL_HUMAN)
  Core: SRSYVPLAH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGXRSXVXLAXSSSAFTITDQV

SEQ ID NO: 342174 - protein, 25 aa, Artificial Sequence
  Description of Artificial Sequence: Synthetic peptide
  Seed: YHRRGSRSYVPLAHSSSAFTITDQV (PMEL_HUMAN)
  Core: RSYVPLAHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSXSYXPXAHXSSAFTITDQV

SEQ ID NO: 342175 - protein, 25 aa, Artificial Sequence
  Description of Artificial Sequence: Synthetic peptide
  Seed: YHRRGSRSYVPLAHSSSAFTITDQV (PMEL_HUMAN)
  Core: YVPLAHSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSXVPXAXSSXAFTITDQV

SEQ ID NO: 342176 - protein, 25 aa, Artificial Sequence
  Description of Artificial Sequence: Synthetic peptide
  Seed: YHRRGSRSYVPLAHSSSAFTITDQV (PMEL_HUMAN)
  Core: LAHSSSAFT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPXAHXSXAFXITDQV

SEQ ID NO: 342177 - protein, 25 aa, Artificial Sequence
  Description of Artificial Sequence: Synthetic peptide
  Seed: YHRRGSRSYVPLAHSSSAFTITDQV (PMEL_HUMAN)
  Core: AHSSSAFTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YHRRGSRSYVPLXHSXSXFTXTDQV

SEQ ID NO: 342178 - protein, 15 aa, Artificial Sequence
  Description of Artificial Sequence: Synthetic peptide
  Seed: YLAEADLSYTWDFGD (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGX

SEQ ID NO: 342179 - protein, 16 aa, Artificial Sequence
  Description of Artificial Sequence: Synthetic peptide
  Seed: YLAEADLSYTWDFGDS (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXS

SEQ ID NO: 342180 - protein, 17 aa, Artificial Sequence
  Description of Artificial Sequence: Synthetic peptide
  Seed: YLAEADLSYTWDFGDSS (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSS

SEQ ID NO: 342181 - protein, 18 aa, Artificial Sequence
  Description of Artificial Sequence: Synthetic peptide
  Seed: YLAEADLSYTWDFGDSSG (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSG

SEQ ID NO: 342182 - protein, 19 aa, Artificial Sequence
  Description of Artificial Sequence: Synthetic peptide
  Seed: YLAEADLSYTWDFGDSSGT (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGT

SEQ ID NO: 342183 - protein, 20 aa, Artificial Sequence
  Description of Artificial Sequence: Synthetic peptide
  Seed: YLAEADLSYTWDFGDSSGTL (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTL

SEQ ID NO: 342184 - protein, 21 aa, Artificial Sequence
  Description of Artificial Sequence: Synthetic peptide
  Seed: YLAEADLSYTWDFGDSSGTLI (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTLI

SEQ ID NO: 342185 - protein, 22 aa, Artificial Sequence
  Description of Artificial Sequence: Synthetic peptide
  Seed: YLAEADLSYTWDFGDSSGTLIS (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTLIS

SEQ ID NO: 342186 - protein, 23 aa, Artificial Sequence
  Description of Artificial Sequence: Synthetic peptide
  Seed: YLAEADLSYTWDFGDSSGTLISR (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTLISR

SEQ ID NO: 342187 - protein, 24 aa, Artificial Sequence
  Description of Artificial Sequence: Synthetic peptide
  Seed: YLAEADLSYTWDFGDSSGTLISRA (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTLISRA

SEQ ID NO: 342188 - protein, 24 aa, Artificial Sequence
  Description of Artificial Sequence: Synthetic peptide
  Seed: YLAEADLSYTWDFGDSSGTLISRA (PMEL_HUMAN)
  Core: WDFGDSSGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADLSYTXDFXDXSGXLISRA

SEQ ID NO: 342189 - protein, 24 aa, Artificial Sequence
  Description of Artificial Sequence: Synthetic peptide
  Seed: YLAEADLSYTWDFGDSSGTLISRA (PMEL_HUMAN)
  Core: SSGTLISRA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADLSYTWDFGDXSGXLXSRX

SEQ ID NO: 342190 - protein, 25 aa, Artificial Sequence
  Description of Artificial Sequence: Synthetic peptide
  Seed: YLAEADLSYTWDFGDSSGTLISRAL (PMEL_HUMAN)
  Core: LSYTWDFGD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADXSYXWXFGXSSGTLISRAL

SEQ ID NO: 342191 - protein, 25 aa, Artificial Sequence
  Description of Artificial Sequence: Synthetic peptide
  Seed: YLAEADLSYTWDFGDSSGTLISRAL (PMEL_HUMAN)
  Core: WDFGDSSGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADLSYTXDFXDXSGXLISRAL

SEQ ID NO: 342192 - protein, 25 aa, Artificial Sequence
  Description of Artificial Sequence: Synthetic peptide
  Seed: YLAEADLSYTWDFGDSSGTLISRAL (PMEL_HUMAN)
  Core: SSGTLISRA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YLAEADLSYTWDFGDXSGXLXSRXL

SEQ ID NO: 342193 - protein, 13 aa, Artificial Sequence
  Description of Artificial Sequence: Synthetic peptide
  Seed: YLEPGPVTAQVVL (PMEL_HUMAN)
  Core: PGPVTAQVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXGPXTXQVXL

SEQ ID NO: 342194 - protein, 14 aa, Artificial Sequence
  Description of Artificial Sequence: Synthetic peptide
  Seed: YLEPGPVTAQVVLQ (PMEL_HUMAN)
  Core: PGPVTAQVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXGPXTXQVXLQ

SEQ ID NO: 342195 - protein, 14 aa, Artificial Sequence
  Description of Artificial Sequence: Synthetic peptide
  Seed: YLEPGPVTAQVVLQ (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLX

SEQ ID NO: 342196 - protein, 15 aa, Artificial Sequence
  Description of Artificial Sequence: Synthetic peptide
  Seed: YLEPGPVTAQVVLQA (PMEL_HUMAN)
  Core: PGPVTAQVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXGPXTXQVXLQA

SEQ ID NO: 342197 - protein, 15 aa, Artificial Sequence
  Description of Artificial Sequence: Synthetic peptide
  Seed: YLEPGPVTAQVVLQA (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXA

SEQ ID NO: 342198 - protein, 15 aa, Artificial Sequence
  Description of Artificial Sequence: Synthetic peptide
  Seed: YLEPGPVTAQVVLQA (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQX

SEQ ID NO: 342199 - protein, 16 aa, Artificial Sequence
  Description of Artificial Sequence: Synthetic peptide
  Seed: YLEPGPVTAQVVLQAA (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAA

SEQ ID NO: 342200 - protein, 16 aa, Artificial Sequence
  Description of Artificial Sequence: Synthetic peptide
  Seed: YLEPGPVTAQVVLQAA (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXA

SEQ ID NO: 342201 - protein, 17 aa, Artificial Sequence
  Description of Artificial Sequence: Synthetic peptide
  Seed: YLEPGPVTAQVVLQAAI (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAI

SEQ ID NO: 342202 - protein, 17 aa, Artificial Sequence
  Description of Artificial Sequence: Synthetic peptide
  Seed: YLEPGPVTAQVVLQAAI (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAI

SEQ ID NO: 342203 - protein, 17 aa, Artificial Sequence
  Description of Artificial Sequence: Synthetic peptide
  Seed: YLEPGPVTAQVVLQAAI (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXI

SEQ ID NO: 342204 - protein, 18 aa, Artificial Sequence
  Description of Artificial Sequence: Synthetic peptide
  Seed: YLEPGPVTAQVVLQAAIP (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIP

SEQ ID NO: 342205 - protein, 18 aa, Artificial Sequence
  Description of Artificial Sequence: Synthetic peptide
  Seed: YLEPGPVTAQVVLQAAIP (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIP

SEQ ID NO: 342206 - protein, 18 aa, Artificial Sequence
  Description of Artificial Sequence: Synthetic peptide
  Seed: YLEPGPVTAQVVLQAAIP (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIP

SEQ ID NO: 342207 - protein, 19 aa, Artificial Sequence
  Description of Artificial Sequence: Synthetic peptide
  Seed: YLEPGPVTAQVVLQAAIPL (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPL

SEQ ID NO: 342208 - protein, 19 aa, Artificial Sequence
  Description of Artificial Sequence: Synthetic peptide
  Seed: YLEPGPVTAQVVLQAAIPL (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPL

SEQ ID NO: 342209 - protein, 19 aa, Artificial Sequence
  Description of Artificial Sequence: Synthetic peptide
  Seed: YLEPGPVTAQVVLQAAIPL (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPL

SEQ ID NO: 342210 - protein, 19 aa, Artificial Sequence
  Description of Artificial Sequence: Synthetic peptide
  Seed: YLEPGPVTAQVVLQAAIPL (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPX

SEQ ID NO: 342211 - protein, 20 aa, Artificial Sequence
  Description of Artificial Sequence: Synthetic peptide
  Seed: YLEPGPVTAQVVLQAAIPLT (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLT

SEQ ID NO: 342212 - protein, 20 aa, Artificial Sequence
  Description of Artificial Sequence: Synthetic peptide
  Seed: YLEPGPVTAQVVLQAAIPLT (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLT

SEQ ID NO: 342213 - protein, 20 aa, Artificial Sequence
  Description of Artificial Sequence: Synthetic peptide
  Seed: YLEPGPVTAQVVLQAAIPLT (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLT

SEQ ID NO: 342214 - protein, 20 aa, Artificial Sequence
  Description of Artificial Sequence: Synthetic peptide
  Seed: YLEPGPVTAQVVLQAAIPLT (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXT

SEQ ID NO: 342215 - protein, 21 aa, Artificial Sequence
  Description of Artificial Sequence: Synthetic peptide
  Seed: YLEPGPVTAQVVLQAAIPLTS (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLTS

SEQ ID NO: 342216 - protein, 21 aa, Artificial Sequence
  Description of Artificial Sequence: Synthetic peptide
  Seed: YLEPGPVTAQVVLQAAIPLTS (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLTS

SEQ ID NO: 342217 - protein, 21 aa, Artificial Sequence
  Description of Artificial Sequence: Synthetic peptide
  Seed: YLEPGPVTAQVVLQAAIPLTS (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLTS

SEQ ID NO: 342218 - protein, 21 aa, Artificial Sequence
  Description of Artificial Sequence: Synthetic peptide
  Seed: YLEPGPVTAQVVLQAAIPLTS (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXTS

SEQ ID NO: 342219 - protein, 21 aa, Artificial Sequence
  Description of Artificial Sequence: Synthetic peptide
  Seed: YLEPGPVTAQVVLQAAIPLTS (PMEL_HUMAN)
  Core: LQAAIPLTS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQVVXQAXIXLTX

SEQ ID NO: 342220 - protein, 22 aa, Artificial Sequence
  Description of Artificial Sequence: Synthetic peptide
  Seed: YLEPGPVTAQVVLQAAIPLTSC (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLTSC

SEQ ID NO: 342221 - protein, 22 aa, Artificial Sequence
  Description of Artificial Sequence: Synthetic peptide
  Seed: YLEPGPVTAQVVLQAAIPLTSC (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLTSC

SEQ ID NO: 342222 - protein, 22 aa, Artificial Sequence
  Description of Artificial Sequence: Synthetic peptide
  Seed: YLEPGPVTAQVVLQAAIPLTSC (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLTSC

SEQ ID NO: 342223 - protein, 22 aa, Artificial Sequence
  Description of Artificial Sequence: Synthetic peptide
  Seed: YLEPGPVTAQVVLQAAIPLTSC (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXTSC

SEQ ID NO: 342224 - protein, 22 aa, Artificial Sequence
  Description of Artificial Sequence: Synthetic peptide
  Seed: YLEPGPVTAQVVLQAAIPLTSC (PMEL_HUMAN)
  Core: LQAAIPLTS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQVVXQAXIXLTXC

SEQ ID NO: 342225 - protein, 23 aa, Artificial Sequence
  Description of Artificial Sequence: Synthetic peptide
  Seed: YLEPGPVTAQVVLQAAIPLTSCG (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLTSCG

SEQ ID NO: 342226 - protein, 23 aa, Artificial Sequence
  Description of Artificial Sequence: Synthetic peptide
  Seed: YLEPGPVTAQVVLQAAIPLTSCG (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLTSCG

SEQ ID NO: 342227 - protein, 23 aa, Artificial Sequence
  Description of Artificial Sequence: Synthetic peptide
  Seed: YLEPGPVTAQVVLQAAIPLTSCG (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLTSCG

SEQ ID NO: 342228 - protein, 23 aa, Artificial Sequence
  Description of Artificial Sequence: Synthetic peptide
  Seed: YLEPGPVTAQVVLQAAIPLTSCG (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXTSCG

SEQ ID NO: 342229 - protein, 23 aa, Artificial Sequence
  Description of Artificial Sequence: Synthetic peptide
  Seed: YLEPGPVTAQVVLQAAIPLTSCG (PMEL_HUMAN)
  Core: LQAAIPLTS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQVVXQAXIXLTXCG

SEQ ID NO: 342230 - protein, 24 aa, Artificial Sequence
  Description of Artificial Sequence: Synthetic peptide
  Seed: YLEPGPVTAQVVLQAAIPLTSCGS (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLTSCGS

SEQ ID NO: 342231 - protein, 24 aa, Artificial Sequence
  Description of Artificial Sequence: Synthetic peptide
  Seed: YLEPGPVTAQVVLQAAIPLTSCGS (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLTSCGS

SEQ ID NO: 342232 - protein, 24 aa, Artificial Sequence
  Description of Artificial Sequence: Synthetic peptide
  Seed: YLEPGPVTAQVVLQAAIPLTSCGS (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLTSCGS

SEQ ID NO: 342233 - protein, 24 aa, Artificial Sequence
  Description of Artificial Sequence: Synthetic peptide
  Seed: YLEPGPVTAQVVLQAAIPLTSCGS (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXTSCGS

SEQ ID NO: 342234 - protein, 24 aa, Artificial Sequence
  Description of Artificial Sequence: Synthetic peptide
  Seed: YLEPGPVTAQVVLQAAIPLTSCGS (PMEL_HUMAN)
  Core: LQAAIPLTS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQVVXQAXIXLTXCGS

SEQ ID NO: 342235 - protein, 25 aa, Artificial Sequence
  Description of Artificial Sequence: Synthetic peptide
  Seed: YLEPGPVTAQVVLQAAIPLTSCGSS (PMEL_HUMAN)
  Core: PVTAQVVLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGXVTXQXVLXAAIPLTSCGSS

SEQ ID NO: 342236 - protein, 25 aa, Artificial Sequence
  Description of Artificial Sequence: Synthetic peptide
  Seed: YLEPGPVTAQVVLQAAIPLTSCGSS (PMEL_HUMAN)
  Core: VTAQVVLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPXTAXVXLQXAIPLTSCGSS

SEQ ID NO: 342237 - protein, 25 aa, Artificial Sequence
  Description of Artificial Sequence: Synthetic peptide
  Seed: YLEPGPVTAQVVLQAAIPLTSCGSS (PMEL_HUMAN)
  Core: TAQVVLQAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVXAQXVXQAXIPLTSCGSS

SEQ ID NO: 342238 - protein, 25 aa, Artificial Sequence
  Description of Artificial Sequence: Synthetic peptide
  Seed: YLEPGPVTAQVVLQAAIPLTSCGSS (PMEL_HUMAN)
  Core: VVLQAAIPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQXVLXAXIPXTSCGSS

SEQ ID NO: 342239 - protein, 25 aa, Artificial Sequence
  Description of Artificial Sequence: Synthetic peptide
  Seed: YLEPGPVTAQVVLQAAIPLTSCGSS (PMEL_HUMAN)
  Core: LQAAIPLTS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YLEPGPVTAQVVXQAXIXLTXCGSS

SEQ ID NO: 342240 - protein, 23 aa, Artificial Sequence
  Description of Artificial Sequence: Synthetic peptide
  Seed: YPEWTEAQRLDCWRGGQVSLKVS (PMEL_HUMAN)
  Core: WRGGQVSLK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YPEWTEAQRLDCXRGXQXSLXVS

SEQ ID NO: 342241 - protein, 24 aa, Artificial Sequence
  Description of Artificial Sequence: Synthetic peptide
  Seed: YPEWTEAQRLDCWRGGQVSLKVSN (PMEL_HUMAN)
  Core: WRGGQVSLK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YPEWTEAQRLDCXRGXQXSLXVSN

SEQ ID NO: 342242 - protein, 25 aa, Artificial Sequence
  Description of Artificial Sequence: Synthetic peptide
  Seed: YPEWTEAQRLDCWRGGQVSLKVSND (PMEL_HUMAN)
  Core: WRGGQVSLK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YPEWTEAQRLDCXRGXQXSLXVSND

SEQ ID NO: 342243 - protein, 15 aa, Artificial Sequence
  Description of Artificial Sequence: Synthetic peptide
  Seed: YRRRLMKQDFSVPQL (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQL

SEQ ID NO: 342244 - protein, 15 aa, Artificial Sequence
  Description of Artificial Sequence: Synthetic peptide
  Seed: YRRRLMKQDFSVPQL (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQL

SEQ ID NO: 342245 - protein, 15 aa, Artificial Sequence
  Description of Artificial Sequence: Synthetic peptide
  Seed: YRRRLMKQDFSVPQL (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXL

SEQ ID NO: 342246 - protein, 16 aa, Artificial Sequence
  Description of Artificial Sequence: Synthetic peptide
  Seed: YRRRLMKQDFSVPQLP (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQLP

SEQ ID NO: 342247 - protein, 16 aa, Artificial Sequence
  Description of Artificial Sequence: Synthetic peptide
  Seed: YRRRLMKQDFSVPQLP (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLP

SEQ ID NO: 342248 - protein, 16 aa, Artificial Sequence
  Description of Artificial Sequence: Synthetic peptide
  Seed: YRRRLMKQDFSVPQLP (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLP

SEQ ID NO: 342249 - protein, 17 aa, Artificial Sequence
  Description of Artificial Sequence: Synthetic peptide
  Seed: YRRRLMKQDFSVPQLPH (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQLPH

SEQ ID NO: 342250 - protein, 17 aa, Artificial Sequence
  Description of Artificial Sequence: Synthetic peptide
  Seed: YRRRLMKQDFSVPQLPH (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPH

SEQ ID NO: 342251 - protein, 17 aa, Artificial Sequence
  Description of Artificial Sequence: Synthetic peptide
  Seed: YRRRLMKQDFSVPQLPH (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPH

SEQ ID NO: 342252 - protein, 18 aa, Artificial Sequence
  Description of Artificial Sequence: Synthetic peptide
  Seed: YRRRLMKQDFSVPQLPHS (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHS

SEQ ID NO: 342253 - protein, 19 aa, Artificial Sequence
  Description of Artificial Sequence: Synthetic peptide
  Seed: YRRRLMKQDFSVPQLPHSS (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQLPHSS

SEQ ID NO: 342254 - protein, 19 aa, Artificial Sequence
  Description of Artificial Sequence: Synthetic peptide
  Seed: YRRRLMKQDFSVPQLPHSS (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSS

SEQ ID NO: 342255 - protein, 19 aa, Artificial Sequence
  Description of Artificial Sequence: Synthetic peptide
  Seed: YRRRLMKQDFSVPQLPHSS (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSS

SEQ ID NO: 342256 - protein, 19 aa, Artificial Sequence
  Description of Artificial Sequence: Synthetic peptide
  Seed: YRRRLMKQDFSVPQLPHSS (PMEL_HUMAN)
  Core: KQDFSVPQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMXQDXSXPQXPHSS

SEQ ID NO: 342257 - protein, 19 aa, Artificial Sequence
  Description of Artificial Sequence: Synthetic peptide
  Seed: YRRRLMKQDFSVPQLPHSS (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXS

SEQ ID NO: 342258 - protein, 20 aa, Artificial Sequence
  Description of Artificial Sequence: Synthetic peptide
  Seed: YRRRLMKQDFSVPQLPHSSS (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQLPHSSS

SEQ ID NO: 342259 - protein, 20 aa, Artificial Sequence
  Description of Artificial Sequence: Synthetic peptide
  Seed: YRRRLMKQDFSVPQLPHSSS (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSS

SEQ ID NO: 342260 - protein, 20 aa, Artificial Sequence
  Description of Artificial Sequence: Synthetic peptide
  Seed: YRRRLMKQDFSVPQLPHSSS (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSS

SEQ ID NO: 342261 - protein, 20 aa, Artificial Sequence
  Description of Artificial Sequence: Synthetic peptide
  Seed: YRRRLMKQDFSVPQLPHSSS (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSS

SEQ ID NO: 342262 - protein, 21 aa, Artificial Sequence
  Description of Artificial Sequence: Synthetic peptide
  Seed: YRRRLMKQDFSVPQLPHSSSH (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSSH

SEQ ID NO: 342263 - protein, 21 aa, Artificial Sequence
  Description of Artificial Sequence: Synthetic peptide
  Seed: YRRRLMKQDFSVPQLPHSSSH (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSSH

SEQ ID NO: 342264 - protein, 21 aa, Artificial Sequence
  Description of Artificial Sequence: Synthetic peptide
  Seed: YRRRLMKQDFSVPQLPHSSSH (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSSH

SEQ ID NO: 342265 - protein, 22 aa, Artificial Sequence
  Description of Artificial Sequence: Synthetic peptide
  Seed: YRRRLMKQDFSVPQLPHSSSHW (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSSHW

SEQ ID NO: 342266 - protein, 22 aa, Artificial Sequence
  Description of Artificial Sequence: Synthetic peptide
  Seed: YRRRLMKQDFSVPQLPHSSSHW (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSSHW

SEQ ID NO: 342267 - protein, 22 aa, Artificial Sequence
  Description of Artificial Sequence: Synthetic peptide
  Seed: YRRRLMKQDFSVPQLPHSSSHW (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSSHW

SEQ ID NO: 342268 - protein, 23 aa, Artificial Sequence
  Description of Artificial Sequence: Synthetic peptide
  Seed: YRRRLMKQDFSVPQLPHSSSHWL (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSSHWL

SEQ ID NO: 342269 - protein, 23 aa, Artificial Sequence
  Description of Artificial Sequence: Synthetic peptide
  Seed: YRRRLMKQDFSVPQLPHSSSHWL (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSSHWL

SEQ ID NO: 342270 - protein, 23 aa, Artificial Sequence
  Description of Artificial Sequence: Synthetic peptide
  Seed: YRRRLMKQDFSVPQLPHSSSHWL (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSSHWL

SEQ ID NO: 342271 - protein, 24 aa, Artificial Sequence
  Description of Artificial Sequence: Synthetic peptide
  Seed: YRRRLMKQDFSVPQLPHSSSHWLR (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSSHWLR

SEQ ID NO: 342272 - protein, 24 aa, Artificial Sequence
  Description of Artificial Sequence: Synthetic peptide
  Seed: YRRRLMKQDFSVPQLPHSSSHWLR (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSSHWLR

SEQ ID NO: 342273 - protein, 24 aa, Artificial Sequence
  Description of Artificial Sequence: Synthetic peptide
  Seed: YRRRLMKQDFSVPQLPHSSSHWLR (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSSHWLR

SEQ ID NO: 342274 - protein, 25 aa, Artificial Sequence
  Description of Artificial Sequence: Synthetic peptide
  Seed: YRRRLMKQDFSVPQLPHSSSHWLRL (PMEL_HUMAN)
  Core: RLMKQDFSV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRRXLMXQXFSXPQLPHSSSHWLRL

SEQ ID NO: 342275 - protein, 25 aa, Artificial Sequence
  Description of Artificial Sequence: Synthetic peptide
  Seed: YRRRLMKQDFSVPQLPHSSSHWLRL (PMEL_HUMAN)
  Core: LMKQDFSVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRRRXMKXDXSVXQLPHSSSHWLRL

SEQ ID NO: 342276 - protein, 25 aa, Artificial Sequence
  Description of Artificial Sequence: Synthetic peptide
  Seed: YRRRLMKQDFSVPQLPHSSSHWLRL (PMEL_HUMAN)
  Core: MKQDFSVPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLXKQXFXVPXLPHSSSHWLRL

SEQ ID NO: 342277 - protein, 25 aa, Artificial Sequence
  Description of Artificial Sequence: Synthetic peptide
  Seed: YRRRLMKQDFSVPQLPHSSSHWLRL (PMEL_HUMAN)
  Core: FSVPQLPHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRRRLMKQDXSVXQXPHXSSHWLRL

SEQ ID NO: 342278 - protein, 13 aa, Artificial Sequence
  Description of Artificial Sequence: Synthetic peptide
  Seed: YRYGSFSVTLDIV (PMEL_HUMAN)
  Core: YRYGSFSVT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRYXSXSVXLDIV

SEQ ID NO: 342279 - protein, 13 aa, Artificial Sequence
  Description of Artificial Sequence: Synthetic peptide
  Seed: YRYGSFSVTLDIV (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIV

SEQ ID NO: 342280 - protein, 13 aa, Artificial Sequence
  Description of Artificial Sequence: Synthetic peptide
  Seed: YRYGSFSVTLDIV (PMEL_HUMAN)
  Core: YGSFSVTLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YRXGSXSXTLXIV

SEQ ID NO: 342281 - protein, 13 aa, Artificial Sequence
  Description of Artificial Sequence: Synthetic peptide
  Seed: YRYGSFSVTLDIV (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIX

SEQ ID NO: 342282 - protein, 14 aa, Artificial Sequence
  Description of Artificial Sequence: Synthetic peptide
  Seed: YRYGSFSVTLDIVQ (PMEL_HUMAN)
  Core: YRYGSFSVT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRYXSXSVXLDIVQ

SEQ ID NO: 342283 - protein, 14 aa, Artificial Sequence
  Description of Artificial Sequence: Synthetic peptide
  Seed: YRYGSFSVTLDIVQ (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQ

SEQ ID NO: 342284 - protein, 14 aa, Artificial Sequence
  Description of Artificial Sequence: Synthetic peptide
  Seed: YRYGSFSVTLDIVQ (PMEL_HUMAN)
  Core: YGSFSVTLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YRXGSXSXTLXIVQ

SEQ ID NO: 342285 - protein, 14 aa, Artificial Sequence
  Description of Artificial Sequence: Synthetic peptide
  Seed: YRYGSFSVTLDIVQ (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQ

SEQ ID NO: 342286 - protein, 14 aa, Artificial Sequence
  Description of Artificial Sequence: Synthetic peptide
  Seed: YRYGSFSVTLDIVQ (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVX

SEQ ID NO: 342287 - protein, 15 aa, Artificial Sequence
  Description of Artificial Sequence: Synthetic peptide
  Seed: YRYGSFSVTLDIVQG (PMEL_HUMAN)
  Core: YRYGSFSVT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRYXSXSVXLDIVQG

SEQ ID NO: 342288 - protein, 15 aa, Artificial Sequence
  Description of Artificial Sequence: Synthetic peptide
  Seed: YRYGSFSVTLDIVQG (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQG

SEQ ID NO: 342289 - protein, 15 aa, Artificial Sequence
  Description of Artificial Sequence: Synthetic peptide
  Seed: YRYGSFSVTLDIVQG (PMEL_HUMAN)
  Core: YGSFSVTLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YRXGSXSXTLXIVQG

SEQ ID NO: 342290 - protein, 15 aa, Artificial Sequence
  Description of Artificial Sequence: Synthetic peptide
  Seed: YRYGSFSVTLDIVQG (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQG

SEQ ID NO: 342291 - protein, 15 aa, Artificial Sequence
  Description of Artificial Sequence: Synthetic peptide
  Seed: YRYGSFSVTLDIVQG (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXG

SEQ ID NO: 342292 - protein, 16 aa, Artificial Sequence
  Description of Artificial Sequence: Synthetic peptide
  Seed: YRYGSFSVTLDIVQGI (PMEL_HUMAN)
  Core: YRYGSFSVT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRYXSXSVXLDIVQGI

SEQ ID NO: 342293 - protein, 16 aa, Artificial Sequence
  Description of Artificial Sequence: Synthetic peptide
  Seed: YRYGSFSVTLDIVQGI (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQGI

SEQ ID NO: 342294 - protein, 16 aa, Artificial Sequence
  Description of Artificial Sequence: Synthetic peptide
  Seed: YRYGSFSVTLDIVQGI (PMEL_HUMAN)
  Core: YGSFSVTLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YRXGSXSXTLXIVQGI

SEQ ID NO: 342295 - protein, 16 aa, Artificial Sequence
  Description of Artificial Sequence: Synthetic peptide
  Seed: YRYGSFSVTLDIVQGI (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQGI

SEQ ID NO: 342296 - protein, 16 aa, Artificial Sequence
  Description of Artificial Sequence: Synthetic peptide
  Seed: YRYGSFSVTLDIVQGI (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGI

SEQ ID NO: 342297 - protein, 16 aa, Artificial Sequence
  Description of Artificial Sequence: Synthetic peptide
  Seed: YRYGSFSVTLDIVQGI (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGX

SEQ ID NO: 342298 - protein, 17 aa, Artificial Sequence
  Description of Artificial Sequence: Synthetic peptide
  Seed: YRYGSFSVTLDIVQGIE (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQGIE

SEQ ID NO: 342299 - protein, 17 aa, Artificial Sequence
  Description of Artificial Sequence: Synthetic peptide
  Seed: YRYGSFSVTLDIVQGIE (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQGIE

SEQ ID NO: 342300 - protein, 17 aa, Artificial Sequence
  Description of Artificial Sequence: Synthetic peptide
  Seed: YRYGSFSVTLDIVQGIE (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIE

SEQ ID NO: 342301 - protein, 17 aa, Artificial Sequence
  Description of Artificial Sequence: Synthetic peptide
  Seed: YRYGSFSVTLDIVQGIE (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXE

SEQ ID NO: 342302 - protein, 18 aa, Artificial Sequence
  Description of Artificial Sequence: Synthetic peptide
  Seed: YRYGSFSVTLDIVQGIES (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQGIES

SEQ ID NO: 342303 - protein, 18 aa, Artificial Sequence
  Description of Artificial Sequence: Synthetic peptide
  Seed: YRYGSFSVTLDIVQGIES (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIES

SEQ ID NO: 342304 - protein, 18 aa, Artificial Sequence
  Description of Artificial Sequence: Synthetic peptide
  Seed: YRYGSFSVTLDIVQGIES (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXES

SEQ ID NO: 342305 - protein, 19 aa, Artificial Sequence
  Description of Artificial Sequence: Synthetic peptide
  Seed: YRYGSFSVTLDIVQGIESA (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQGIESA

SEQ ID NO: 342306 - protein, 19 aa, Artificial Sequence
  Description of Artificial Sequence: Synthetic peptide
  Seed: YRYGSFSVTLDIVQGIESA (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESA

SEQ ID NO: 342307 - protein, 19 aa, Artificial Sequence
  Description of Artificial Sequence: Synthetic peptide
  Seed: YRYGSFSVTLDIVQGIESA (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESA

SEQ ID NO: 342308 - protein, 20 aa, Artificial Sequence
  Description of Artificial Sequence: Synthetic peptide
  Seed: YRYGSFSVTLDIVQGIESAE (PMEL_HUMAN)
  Core: RYGSFSVTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXYGXFXVTXDIVQGIESAE

SEQ ID NO: 342309 - protein, 20 aa, Artificial Sequence
  Description of Artificial Sequence: Synthetic peptide
  Seed: YRYGSFSVTLDIVQGIESAE (PMEL_HUMAN)
  Core: YGSFSVTLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YRXGSXSXTLXIVQGIESAE

SEQ ID NO: 342310 - protein, 20 aa, Artificial Sequence
  Description of Artificial Sequence: Synthetic peptide
  Seed: YRYGSFSVTLDIVQGIESAE (PMEL_HUMAN)
  Core: GSFSVTLDI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRYXSFXVXLDXVQGIESAE

SEQ ID NO: 342311 - protein, 20 aa, Artificial Sequence
  Description of Artificial Sequence: Synthetic peptide
  Seed: YRYGSFSVTLDIVQGIESAE (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQGIESAE

SEQ ID NO: 342312 - protein, 20 aa, Artificial Sequence
  Description of Artificial Sequence: Synthetic peptide
  Seed: YRYGSFSVTLDIVQGIESAE (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAE

SEQ ID NO: 342313 - protein, 20 aa, Artificial Sequence
  Description of Artificial Sequence: Synthetic peptide
  Seed: YRYGSFSVTLDIVQGIESAE (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAE

SEQ ID NO: 342314 - protein, 20 aa, Artificial Sequence
  Description of Artificial Sequence: Synthetic peptide
  Seed: YRYGSFSVTLDIVQGIESAE (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAE

SEQ ID NO: 342315 - protein, 21 aa, Artificial Sequence
  Description of Artificial Sequence: Synthetic peptide
  Seed: YRYGSFSVTLDIVQGIESAEI (PMEL_HUMAN)
  Core: SFSVTLDIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRYGXFSXTXDIXQGIESAEI

SEQ ID NO: 342316 - protein, 21 aa, Artificial Sequence
  Description of Artificial Sequence: Synthetic peptide
  Seed: YRYGSFSVTLDIVQGIESAEI (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAEI

SEQ ID NO: 342317 - protein, 21 aa, Artificial Sequence
  Description of Artificial Sequence: Synthetic peptide
  Seed: YRYGSFSVTLDIVQGIESAEI (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAEI

SEQ ID NO: 342318 - protein, 21 aa, Artificial Sequence
  Description of Artificial Sequence: Synthetic peptide
  Seed: YRYGSFSVTLDIVQGIESAEI (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAEI

SEQ ID NO: 342319 - protein, 21 aa, Artificial Sequence
  Description of Artificial Sequence: Synthetic peptide
  Seed: YRYGSFSVTLDIVQGIESAEI (PMEL_HUMAN)
  Core: VQGIESAEI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIXQGXEXAEX

SEQ ID NO: 342320 - protein, 22 aa, Artificial Sequence
  Description of Artificial Sequence: Synthetic peptide
  Seed: YRYGSFSVTLDIVQGIESAEIL (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAEIL

SEQ ID NO: 342321 - protein, 22 aa, Artificial Sequence
  Description of Artificial Sequence: Synthetic peptide
  Seed: YRYGSFSVTLDIVQGIESAEIL (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAEIL

SEQ ID NO: 342322 - protein, 22 aa, Artificial Sequence
  Description of Artificial Sequence: Synthetic peptide
  Seed: YRYGSFSVTLDIVQGIESAEIL (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAEIL

SEQ ID NO: 342323 - protein, 22 aa, Artificial Sequence
  Description of Artificial Sequence: Synthetic peptide
  Seed: YRYGSFSVTLDIVQGIESAEIL (PMEL_HUMAN)
  Core: VQGIESAEI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIXQGXEXAEXL

SEQ ID NO: 342324 - protein, 23 aa, Artificial Sequence
  Description of Artificial Sequence: Synthetic peptide
  Seed: YRYGSFSVTLDIVQGIESAEILQ (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAEILQ

SEQ ID NO: 342325 - protein, 23 aa, Artificial Sequence
  Description of Artificial Sequence: Synthetic peptide
  Seed: YRYGSFSVTLDIVQGIESAEILQ (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAEILQ

SEQ ID NO: 342326 - protein, 23 aa, Artificial Sequence
  Description of Artificial Sequence: Synthetic peptide
  Seed: YRYGSFSVTLDIVQGIESAEILQ (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAEILQ

SEQ ID NO: 342327 - protein, 23 aa, Artificial Sequence
  Description of Artificial Sequence: Synthetic peptide
  Seed: YRYGSFSVTLDIVQGIESAEILQ (PMEL_HUMAN)
  Core: VQGIESAEI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIXQGXEXAEXLQ

SEQ ID NO: 342328 - protein, 24 aa, Artificial Sequence
  Description of Artificial Sequence: Synthetic peptide
  Seed: YRYGSFSVTLDIVQGIESAEILQA (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAEILQA

SEQ ID NO: 342329 - protein, 24 aa, Artificial Sequence
  Description of Artificial Sequence: Synthetic peptide
  Seed: YRYGSFSVTLDIVQGIESAEILQA (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAEILQA

SEQ ID NO: 342330 - protein, 24 aa, Artificial Sequence
  Description of Artificial Sequence: Synthetic peptide
  Seed: YRYGSFSVTLDIVQGIESAEILQA (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAEILQA

SEQ ID NO: 342331 - protein, 24 aa, Artificial Sequence
  Description of Artificial Sequence: Synthetic peptide
  Seed: YRYGSFSVTLDIVQGIESAEILQA (PMEL_HUMAN)
  Core: VQGIESAEI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIXQGXEXAEXLQA

SEQ ID NO: 342332 - protein, 24 aa, Artificial Sequence
  Description of Artificial Sequence: Synthetic peptide
  Seed: YRYGSFSVTLDIVQGIESAEILQA (PMEL_HUMAN)
  Core: IESAEILQA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIVQGXESXEXLQX

SEQ ID NO: 342333 - protein, 25 aa, Artificial Sequence
  Description of Artificial Sequence: Synthetic peptide
  Seed: YRYGSFSVTLDIVQGIESAEILQAV (PMEL_HUMAN)
  Core: FSVTLDIVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSXSVXLXIVXGIESAEILQAV

SEQ ID NO: 342334 - protein, 25 aa, Artificial Sequence
  Description of Artificial Sequence: Synthetic peptide
  Seed: YRYGSFSVTLDIVQGIESAEILQAV (PMEL_HUMAN)
  Core: VTLDIVQGI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSXTLXIXQGXESAEILQAV

SEQ ID NO: 342335 - protein, 25 aa, Artificial Sequence
  Description of Artificial Sequence: Synthetic peptide
  Seed: YRYGSFSVTLDIVQGIESAEILQAV (PMEL_HUMAN)
  Core: LDIVQGIES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTXDIXQXIEXAEILQAV

SEQ ID NO: 342336 - protein, 25 aa, Artificial Sequence
  Description of Artificial Sequence: Synthetic peptide
  Seed: YRYGSFSVTLDIVQGIESAEILQAV (PMEL_HUMAN)
  Core: VQGIESAEI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIXQGXEXAEXLQAV

SEQ ID NO: 342337 - protein, 25 aa, Artificial Sequence
  Description of Artificial Sequence: Synthetic peptide
  Seed: YRYGSFSVTLDIVQGIESAEILQAV (PMEL_HUMAN)
  Core: IESAEILQA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YRYGSFSVTLDIVQGXESXEXLQXV

SEQ ID NO: 342338 - protein, 14 aa, Artificial Sequence
  Description of Artificial Sequence: Synthetic peptide
  Seed: YTWDFGDSSGTLIS (PMEL_HUMAN)
  Core: WDFGDSSGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXDFXDXSGXLIS

SEQ ID NO: 342339 - protein, 15 aa, Artificial Sequence
  Description of Artificial Sequence: Synthetic peptide
  Seed: YTWDFGDSSGTLISR (PMEL_HUMAN)
  Core: WDFGDSSGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXDFXDXSGXLISR

SEQ ID NO: 342340 - protein, 15 aa, Artificial Sequence
  Description of Artificial Sequence: Synthetic peptide
  Seed: YTWDFGDSSGTLISR (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSR

SEQ ID NO: 342341 - protein, 16 aa, Artificial Sequence
  Description of Artificial Sequence: Synthetic peptide
  Seed: YTWDFGDSSGTLISRA (PMEL_HUMAN)
  Core: WDFGDSSGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXDFXDXSGXLISRA

SEQ ID NO: 342342 - protein, 16 aa, Artificial Sequence
  Description of Artificial Sequence: Synthetic peptide
  Seed: YTWDFGDSSGTLISRA (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRA

SEQ ID NO: 342343 - protein, 16 aa, Artificial Sequence
  Description of Artificial Sequence: Synthetic peptide
  Seed: YTWDFGDSSGTLISRA (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRX

SEQ ID NO: 342344 - protein, 17 aa, Artificial Sequence
  Description of Artificial Sequence: Synthetic peptide
  Seed: YTWDFGDSSGTLISRAL (PMEL_HUMAN)
  Core: WDFGDSSGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXDFXDXSGXLISRAL

SEQ ID NO: 342345 - protein, 17 aa, Artificial Sequence
  Description of Artificial Sequence: Synthetic peptide
  Seed: YTWDFGDSSGTLISRAL (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRAL

SEQ ID NO: 342346 - protein, 17 aa, Artificial Sequence
  Description of Artificial Sequence: Synthetic peptide
  Seed: YTWDFGDSSGTLISRAL (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXL

SEQ ID NO: 342347 - protein, 18 aa, Artificial Sequence
  Description of Artificial Sequence: Synthetic peptide
  Seed: YTWDFGDSSGTLISRALV (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLV

SEQ ID NO: 342348 - protein, 19 aa, Artificial Sequence
  Description of Artificial Sequence: Synthetic peptide
  Seed: YTWDFGDSSGTLISRALVV (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVV

SEQ ID NO: 342349 - protein, 19 aa, Artificial Sequence
  Description of Artificial Sequence: Synthetic peptide
  Seed: YTWDFGDSSGTLISRALVV (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVV

SEQ ID NO: 342350 - protein, 20 aa, Artificial Sequence
  Description of Artificial Sequence: Synthetic peptide
  Seed: YTWDFGDSSGTLISRALVVT (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVT

SEQ ID NO: 342351 - protein, 20 aa, Artificial Sequence
  Description of Artificial Sequence: Synthetic peptide
  Seed: YTWDFGDSSGTLISRALVVT (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVT

SEQ ID NO: 342352 - protein, 20 aa, Artificial Sequence
  Description of Artificial Sequence: Synthetic peptide
  Seed: YTWDFGDSSGTLISRALVVT (PMEL_HUMAN)
  Core: SGTLISRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSXGTXIXRAXVVT

SEQ ID NO: 342353 - protein, 20 aa, Artificial Sequence
  Description of Artificial Sequence: Synthetic peptide
  Seed: YTWDFGDSSGTLISRALVVT (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXT

SEQ ID NO: 342354 - protein, 21 aa, Artificial Sequence
  Description of Artificial Sequence: Synthetic peptide
  Seed: YTWDFGDSSGTLISRALVVTH (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVTH

SEQ ID NO: 342355 - protein, 21 aa, Artificial Sequence
  Description of Artificial Sequence: Synthetic peptide
  Seed: YTWDFGDSSGTLISRALVVTH (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVTH

SEQ ID NO: 342356 - protein, 21 aa, Artificial Sequence
  Description of Artificial Sequence: Synthetic peptide
  Seed: YTWDFGDSSGTLISRALVVTH (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXTH

SEQ ID NO: 342357 - protein, 21 aa, Artificial Sequence
  Description of Artificial Sequence: Synthetic peptide
  Seed: YTWDFGDSSGTLISRALVVTH (PMEL_HUMAN)
  Core: LISRALVVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTXISXAXVVXH

SEQ ID NO: 342358 - protein, 22 aa, Artificial Sequence
  Description of Artificial Sequence: Synthetic peptide
  Seed: YTWDFGDSSGTLISRALVVTHT (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVTHT

SEQ ID NO: 342359 - protein, 22 aa, Artificial Sequence
  Description of Artificial Sequence: Synthetic peptide
  Seed: YTWDFGDSSGTLISRALVVTHT (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVTHT

SEQ ID NO: 342360 - protein, 22 aa, Artificial Sequence
  Description of Artificial Sequence: Synthetic peptide
  Seed: YTWDFGDSSGTLISRALVVTHT (PMEL_HUMAN)
  Core: SGTLISRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSXGTXIXRAXVVTHT

SEQ ID NO: 342361 - protein, 22 aa, Artificial Sequence
  Description of Artificial Sequence: Synthetic peptide
  Seed: YTWDFGDSSGTLISRALVVTHT (PMEL_HUMAN)
  Core: GTLISRALV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSXTLXSXALXVTHT

SEQ ID NO: 342362 - protein, 22 aa, Artificial Sequence
  Description of Artificial Sequence: Synthetic peptide
  Seed: YTWDFGDSSGTLISRALVVTHT (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXTHT

SEQ ID NO: 342363 - protein, 22 aa, Artificial Sequence
  Description of Artificial Sequence: Synthetic peptide
  Seed: YTWDFGDSSGTLISRALVVTHT (PMEL_HUMAN)
  Core: LISRALVVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTXISXAXVVXHT

SEQ ID NO: 342364 - protein, 23 aa, Artificial Sequence
  Description of Artificial Sequence: Synthetic peptide
  Seed: YTWDFGDSSGTLISRALVVTHTY (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVTHTY

SEQ ID NO: 342365 - protein, 23 aa, Artificial Sequence
  Description of Artificial Sequence: Synthetic peptide
  Seed: YTWDFGDSSGTLISRALVVTHTY (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVTHTY

SEQ ID NO: 342366 - protein, 23 aa, Artificial Sequence
  Description of Artificial Sequence: Synthetic peptide
  Seed: YTWDFGDSSGTLISRALVVTHTY (PMEL_HUMAN)
  Core: SGTLISRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSXGTXIXRAXVVTHTY

SEQ ID NO: 342367 - protein, 23 aa, Artificial Sequence
  Description of Artificial Sequence: Synthetic peptide
  Seed: YTWDFGDSSGTLISRALVVTHTY (PMEL_HUMAN)
  Core: GTLISRALV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSXTLXSXALXVTHTY

SEQ ID NO: 342368 - protein, 23 aa, Artificial Sequence
  Description of Artificial Sequence: Synthetic peptide
  Seed: YTWDFGDSSGTLISRALVVTHTY (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXTHTY

SEQ ID NO: 342369 - protein, 23 aa, Artificial Sequence
  Description of Artificial Sequence: Synthetic peptide
  Seed: YTWDFGDSSGTLISRALVVTHTY (PMEL_HUMAN)
  Core: LISRALVVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTXISXAXVVXHTY

SEQ ID NO: 342370 - protein, 23 aa, Artificial Sequence
  Description of Artificial Sequence: Synthetic peptide
  Seed: YTWDFGDSSGTLISRALVVTHTY (PMEL_HUMAN)
  Core: ISRALVVTH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLXSRXLXVTXTY

SEQ ID NO: 342371 - protein, 23 aa, Artificial Sequence
  Description of Artificial Sequence: Synthetic peptide
  Seed: YTWDFGDSSGTLISRALVVTHTY (PMEL_HUMAN)
  Core: SRALVVTHT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLIXRAXVXTHXY

SEQ ID NO: 342372 - protein, 24 aa, Artificial Sequence
  Description of Artificial Sequence: Synthetic peptide
  Seed: YTWDFGDSSGTLISRALVVTHTYL (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVTHTYL

SEQ ID NO: 342373 - protein, 24 aa, Artificial Sequence
  Description of Artificial Sequence: Synthetic peptide
  Seed: YTWDFGDSSGTLISRALVVTHTYL (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVTHTYL

SEQ ID NO: 342374 - protein, 24 aa, Artificial Sequence
  Description of Artificial Sequence: Synthetic peptide
  Seed: YTWDFGDSSGTLISRALVVTHTYL (PMEL_HUMAN)
  Core: SGTLISRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSXGTXIXRAXVVTHTYL

SEQ ID NO: 342375 - protein, 24 aa, Artificial Sequence
  Description of Artificial Sequence: Synthetic peptide
  Seed: YTWDFGDSSGTLISRALVVTHTYL (PMEL_HUMAN)
  Core: GTLISRALV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSXTLXSXALXVTHTYL

SEQ ID NO: 342376 - protein, 24 aa, Artificial Sequence
  Description of Artificial Sequence: Synthetic peptide
  Seed: YTWDFGDSSGTLISRALVVTHTYL (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXTHTYL

SEQ ID NO: 342377 - protein, 24 aa, Artificial Sequence
  Description of Artificial Sequence: Synthetic peptide
  Seed: YTWDFGDSSGTLISRALVVTHTYL (PMEL_HUMAN)
  Core: LISRALVVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTXISXAXVVXHTYL

SEQ ID NO: 342378 - protein, 24 aa, Artificial Sequence
  Description of Artificial Sequence: Synthetic peptide
  Seed: YTWDFGDSSGTLISRALVVTHTYL (PMEL_HUMAN)
  Core: ISRALVVTH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLXSRXLXVTXTYL

SEQ ID NO: 342379 - protein, 24 aa, Artificial Sequence
  Description of Artificial Sequence: Synthetic peptide
  Seed: YTWDFGDSSGTLISRALVVTHTYL (PMEL_HUMAN)
  Core: SRALVVTHT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLIXRAXVXTHXYL

SEQ ID NO: 342380 - protein, 25 aa, Artificial Sequence
  Description of Artificial Sequence: Synthetic peptide
  Seed: YTWDFGDSSGTLISRALVVTHTYLE (PMEL_HUMAN)
  Core: FGDSSGTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YTWDXGDXSXTLXSRALVVTHTYLE

SEQ ID NO: 342381 - protein, 25 aa, Artificial Sequence
  Description of Artificial Sequence: Synthetic peptide
  Seed: YTWDFGDSSGTLISRALVVTHTYLE (PMEL_HUMAN)
  Core: SSGTLISRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDXSGXLXSRXLVVTHTYLE

SEQ ID NO: 342382 - protein, 25 aa, Artificial Sequence
  Description of Artificial Sequence: Synthetic peptide
  Seed: YTWDFGDSSGTLISRALVVTHTYLE (PMEL_HUMAN)
  Core: SGTLISRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSXGTXIXRAXVVTHTYLE

SEQ ID NO: 342383 - protein, 25 aa, Artificial Sequence
  Description of Artificial Sequence: Synthetic peptide
  Seed: YTWDFGDSSGTLISRALVVTHTYLE (PMEL_HUMAN)
  Core: GTLISRALV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSXTLXSXALXVTHTYLE

SEQ ID NO: 342384 - protein, 25 aa, Artificial Sequence
  Description of Artificial Sequence: Synthetic peptide
  Seed: YTWDFGDSSGTLISRALVVTHTYLE (PMEL_HUMAN)
  Core: TLISRALVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGXLIXRXLVXTHTYLE

SEQ ID NO: 342385 - protein, 25 aa, Artificial Sequence
  Description of Artificial Sequence: Synthetic peptide
  Seed: YTWDFGDSSGTLISRALVVTHTYLE (PMEL_HUMAN)
  Core: LISRALVVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTXISXAXVVXHTYLE

SEQ ID NO: 342386 - protein, 25 aa, Artificial Sequence
  Description of Artificial Sequence: Synthetic peptide
  Seed: YTWDFGDSSGTLISRALVVTHTYLE (PMEL_HUMAN)
  Core: ISRALVVTH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLXSRXLXVTXTYLE

SEQ ID NO: 342387 - protein, 25 aa, Artificial Sequence
  Description of Artificial Sequence: Synthetic peptide
  Seed: YTWDFGDSSGTLISRALVVTHTYLE (PMEL_HUMAN)
  Core: SRALVVTHT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLIXRAXVXTHXYLE

SEQ ID NO: 342388 - protein, 25 aa, Artificial Sequence
  Description of Artificial Sequence: Synthetic peptide
  Seed: YTWDFGDSSGTLISRALVVTHTYLE (PMEL_HUMAN)
  Core: RALVVTHTY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLISXALXVXHTXLE

SEQ ID NO: 342389 - protein, 25 aa, Artificial Sequence
  Description of Artificial Sequence: Synthetic peptide
  Seed: YTWDFGDSSGTLISRALVVTHTYLE (PMEL_HUMAN)
  Core: LVVTHTYLE
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
YTWDFGDSSGTLISRAXVVXHXYLX

SEQ ID NO: 342390 - protein, 13 aa, Artificial Sequence
  Description of Artificial Sequence: Synthetic peptide
  Seed: YVPLAHSSSAFTI (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXI

SEQ ID NO: 342391 - protein, 13 aa, Artificial Sequence
  Description of Artificial Sequence: Synthetic peptide
  Seed: YVPLAHSSSAFTI (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTX

SEQ ID NO: 342392 - protein, 14 aa, Artificial Sequence
  Description of Artificial Sequence: Synthetic peptide
  Seed: YVPLAHSSSAFTIT (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXIT

SEQ ID NO: 342393 - protein, 14 aa, Artificial Sequence
  Description of Artificial Sequence: Synthetic peptide
  Seed: YVPLAHSSSAFTIT (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXT

SEQ ID NO: 342394 - protein, 15 aa, Artificial Sequence
  Description of Artificial Sequence: Synthetic peptide
  Seed: YVPLAHSSSAFTITD (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITD

SEQ ID NO: 342395 - protein, 15 aa, Artificial Sequence
  Description of Artificial Sequence: Synthetic peptide
  Seed: YVPLAHSSSAFTITD (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTD

SEQ ID NO: 342396 - protein, 16 aa, Artificial Sequence
  Description of Artificial Sequence: Synthetic peptide
  Seed: YVPLAHSSSAFTITDQ (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQ

SEQ ID NO: 342397 - protein, 16 aa, Artificial Sequence
  Description of Artificial Sequence: Synthetic peptide
  Seed: YVPLAHSSSAFTITDQ (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQ

SEQ ID NO: 342398 - protein, 17 aa, Artificial Sequence
  Description of Artificial Sequence: Synthetic peptide
  Seed: YVPLAHSSSAFTITDQV (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQV

SEQ ID NO: 342399 - protein, 17 aa, Artificial Sequence
  Description of Artificial Sequence: Synthetic peptide
  Seed: YVPLAHSSSAFTITDQV (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQV

SEQ ID NO: 342400 - protein, 18 aa, Artificial Sequence
  Description of Artificial Sequence: Synthetic peptide
  Seed: YVPLAHSSSAFTITDQVP (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVP

SEQ ID NO: 342401 - protein, 18 aa, Artificial Sequence
  Description of Artificial Sequence: Synthetic peptide
  Seed: YVPLAHSSSAFTITDQVP (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVP

SEQ ID NO: 342402 - protein, 18 aa, Artificial Sequence
  Description of Artificial Sequence: Synthetic peptide
  Seed: YVPLAHSSSAFTITDQVP (PMEL_HUMAN)
  Core: SSSAFTITD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHXSSXFXITXQVP

SEQ ID NO: 342403 - protein, 19 aa, Artificial Sequence
  Description of Artificial Sequence: Synthetic peptide
  Seed: YVPLAHSSSAFTITDQVPF (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPF

SEQ ID NO: 342404 - protein, 19 aa, Artificial Sequence
  Description of Artificial Sequence: Synthetic peptide
  Seed: YVPLAHSSSAFTITDQVPF (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPF

SEQ ID NO: 342405 - protein, 19 aa, Artificial Sequence
  Description of Artificial Sequence: Synthetic peptide
  Seed: YVPLAHSSSAFTITDQVPF (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPF

SEQ ID NO: 342406 - protein, 19 aa, Artificial Sequence
  Description of Artificial Sequence: Synthetic peptide
  Seed: YVPLAHSSSAFTITDQVPF (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPF

SEQ ID NO: 342407 - protein, 19 aa, Artificial Sequence
  Description of Artificial Sequence: Synthetic peptide
  Seed: YVPLAHSSSAFTITDQVPF (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPF

SEQ ID NO: 342408 - protein, 19 aa, Artificial Sequence
  Description of Artificial Sequence: Synthetic peptide
  Seed: YVPLAHSSSAFTITDQVPF (PMEL_HUMAN)
  Core: AFTITDQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSXFTXTXQVXF

SEQ ID NO: 342409 - protein, 20 aa, Artificial Sequence
  Description of Artificial Sequence: Synthetic peptide
  Seed: YVPLAHSSSAFTITDQVPFS (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFS

SEQ ID NO: 342410 - protein, 20 aa, Artificial Sequence
  Description of Artificial Sequence: Synthetic peptide
  Seed: YVPLAHSSSAFTITDQVPFS (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFS

SEQ ID NO: 342411 - protein, 20 aa, Artificial Sequence
  Description of Artificial Sequence: Synthetic peptide
  Seed: YVPLAHSSSAFTITDQVPFS (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFS

SEQ ID NO: 342412 - protein, 20 aa, Artificial Sequence
  Description of Artificial Sequence: Synthetic peptide
  Seed: YVPLAHSSSAFTITDQVPFS (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFS

SEQ ID NO: 342413 - protein, 20 aa, Artificial Sequence
  Description of Artificial Sequence: Synthetic peptide
  Seed: YVPLAHSSSAFTITDQVPFS (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFS

SEQ ID NO: 342414 - protein, 20 aa, Artificial Sequence
  Description of Artificial Sequence: Synthetic peptide
  Seed: YVPLAHSSSAFTITDQVPFS (PMEL_HUMAN)
  Core: AFTITDQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSXFTXTXQVXFS

SEQ ID NO: 342415 - protein, 20 aa, Artificial Sequence
  Description of Artificial Sequence: Synthetic peptide
  Seed: YVPLAHSSSAFTITDQVPFS (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXS

SEQ ID NO: 342416 - protein, 21 aa, Artificial Sequence
  Description of Artificial Sequence: Synthetic peptide
  Seed: YVPLAHSSSAFTITDQVPFSV (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFSV

SEQ ID NO: 342417 - protein, 21 aa, Artificial Sequence
  Description of Artificial Sequence: Synthetic peptide
  Seed: YVPLAHSSSAFTITDQVPFSV (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFSV

SEQ ID NO: 342418 - protein, 21 aa, Artificial Sequence
  Description of Artificial Sequence: Synthetic peptide
  Seed: YVPLAHSSSAFTITDQVPFSV (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFSV

SEQ ID NO: 342419 - protein, 21 aa, Artificial Sequence
  Description of Artificial Sequence: Synthetic peptide
  Seed: YVPLAHSSSAFTITDQVPFSV (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFSV

SEQ ID NO: 342420 - protein, 21 aa, Artificial Sequence
  Description of Artificial Sequence: Synthetic peptide
  Seed: YVPLAHSSSAFTITDQVPFSV (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFSV

SEQ ID NO: 342421 - protein, 21 aa, Artificial Sequence
  Description of Artificial Sequence: Synthetic peptide
  Seed: YVPLAHSSSAFTITDQVPFSV (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXSV

SEQ ID NO: 342422 - protein, 22 aa, Artificial Sequence
  Description of Artificial Sequence: Synthetic peptide
  Seed: YVPLAHSSSAFTITDQVPFSVS (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFSVS

SEQ ID NO: 342423 - protein, 22 aa, Artificial Sequence
  Description of Artificial Sequence: Synthetic peptide
  Seed: YVPLAHSSSAFTITDQVPFSVS (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFSVS

SEQ ID NO: 342424 - protein, 22 aa, Artificial Sequence
  Description of Artificial Sequence: Synthetic peptide
  Seed: YVPLAHSSSAFTITDQVPFSVS (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFSVS

SEQ ID NO: 342425 - protein, 22 aa, Artificial Sequence
  Description of Artificial Sequence: Synthetic peptide
  Seed: YVPLAHSSSAFTITDQVPFSVS (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFSVS

SEQ ID NO: 342426 - protein, 22 aa, Artificial Sequence
  Description of Artificial Sequence: Synthetic peptide
  Seed: YVPLAHSSSAFTITDQVPFSVS (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFSVS

SEQ ID NO: 342427 - protein, 22 aa, Artificial Sequence
  Description of Artificial Sequence: Synthetic peptide
  Seed: YVPLAHSSSAFTITDQVPFSVS (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXSVS

SEQ ID NO: 342428 - protein, 23 aa, Artificial Sequence
  Description of Artificial Sequence: Synthetic peptide
  Seed: YVPLAHSSSAFTITDQVPFSVSV (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFSVSV

SEQ ID NO: 342429 - protein, 23 aa, Artificial Sequence
  Description of Artificial Sequence: Synthetic peptide
  Seed: YVPLAHSSSAFTITDQVPFSVSV (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFSVSV

SEQ ID NO: 342430 - protein, 23 aa, Artificial Sequence
  Description of Artificial Sequence: Synthetic peptide
  Seed: YVPLAHSSSAFTITDQVPFSVSV (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFSVSV

SEQ ID NO: 342431 - protein, 23 aa, Artificial Sequence
  Description of Artificial Sequence: Synthetic peptide
  Seed: YVPLAHSSSAFTITDQVPFSVSV (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFSVSV

SEQ ID NO: 342432 - protein, 23 aa, Artificial Sequence
  Description of Artificial Sequence: Synthetic peptide
  Seed: YVPLAHSSSAFTITDQVPFSVSV (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFSVSV

SEQ ID NO: 342433 - protein, 23 aa, Artificial Sequence
  Description of Artificial Sequence: Synthetic peptide
  Seed: YVPLAHSSSAFTITDQVPFSVSV (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXSVSV

SEQ ID NO: 342434 - protein, 24 aa, Artificial Sequence
  Description of Artificial Sequence: Synthetic peptide
  Seed: YVPLAHSSSAFTITDQVPFSVSVS (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFSVSVS

SEQ ID NO: 342435 - protein, 24 aa, Artificial Sequence
  Description of Artificial Sequence: Synthetic peptide
  Seed: YVPLAHSSSAFTITDQVPFSVSVS (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFSVSVS

SEQ ID NO: 342436 - protein, 24 aa, Artificial Sequence
  Description of Artificial Sequence: Synthetic peptide
  Seed: YVPLAHSSSAFTITDQVPFSVSVS (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFSVSVS

SEQ ID NO: 342437 - protein, 24 aa, Artificial Sequence
  Description of Artificial Sequence: Synthetic peptide
  Seed: YVPLAHSSSAFTITDQVPFSVSVS (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFSVSVS

SEQ ID NO: 342438 - protein, 24 aa, Artificial Sequence
  Description of Artificial Sequence: Synthetic peptide
  Seed: YVPLAHSSSAFTITDQVPFSVSVS (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFSVSVS

SEQ ID NO: 342439 - protein, 24 aa, Artificial Sequence
  Description of Artificial Sequence: Synthetic peptide
  Seed: YVPLAHSSSAFTITDQVPFSVSVS (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXSVSVS

SEQ ID NO: 342440 - protein, 24 aa, Artificial Sequence
  Description of Artificial Sequence: Synthetic peptide
  Seed: YVPLAHSSSAFTITDQVPFSVSVS (PMEL_HUMAN)
  Core: ITDQVPFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAFTXTDXVXFSXSVS

SEQ ID NO: 342441 - protein, 25 aa, Artificial Sequence
  Description of Artificial Sequence: Synthetic peptide
  Seed: YVPLAHSSSAFTITDQVPFSVSVSQ (PMEL_HUMAN)
  Core: LAHSSSAFT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVPXAHXSXAFXITDQVPFSVSVSQ

SEQ ID NO: 342442 - protein, 25 aa, Artificial Sequence
  Description of Artificial Sequence: Synthetic peptide
  Seed: YVPLAHSSSAFTITDQVPFSVSVSQ (PMEL_HUMAN)
  Core: AHSSSAFTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVPLXHSXSXFTXTDQVPFSVSVSQ

SEQ ID NO: 342443 - protein, 25 aa, Artificial Sequence
  Description of Artificial Sequence: Synthetic peptide
  Seed: YVPLAHSSSAFTITDQVPFSVSVSQ (PMEL_HUMAN)
  Core: HSSSAFTIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAXSSXAXTIXDQVPFSVSVSQ

SEQ ID NO: 342444 - protein, 25 aa, Artificial Sequence
  Description of Artificial Sequence: Synthetic peptide
  Seed: YVPLAHSSSAFTITDQVPFSVSVSQ (PMEL_HUMAN)
  Core: SSAFTITDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSXSAXTXTDXVPFSVSVSQ

SEQ ID NO: 342445 - protein, 25 aa, Artificial Sequence
  Description of Artificial Sequence: Synthetic peptide
  Seed: YVPLAHSSSAFTITDQVPFSVSVSQ (PMEL_HUMAN)
  Core: SAFTITDQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSXAFXIXDQXPFSVSVSQ

SEQ ID NO: 342446 - protein, 25 aa, Artificial Sequence
  Description of Artificial Sequence: Synthetic peptide
  Seed: YVPLAHSSSAFTITDQVPFSVSVSQ (PMEL_HUMAN)
  Core: FTITDQVPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAXTIXDXVPXSVSVSQ

SEQ ID NO: 342447 - protein, 25 aa, Artificial Sequence
  Description of Artificial Sequence: Synthetic peptide
  Seed: YVPLAHSSSAFTITDQVPFSVSVSQ (PMEL_HUMAN)
  Core: ITDQVPFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YVPLAHSSSAFTXTDXVXFSXSVSQ

SEQ ID NO: 342448 - protein, 14 aa, Artificial Sequence
  Description of Artificial Sequence: Synthetic peptide
  Seed: YVWKTWGQYWQVLG (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXG

SEQ ID NO: 342449 - protein, 15 aa, Artificial Sequence
  Description of Artificial Sequence: Synthetic peptide
  Seed: YVWKTWGQYWQVLGG (PMEL_HUMAN)
  Core: WKTWGQYWQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXKTXGXYWXVLGG

SEQ ID NO: 342450 - protein, 15 aa, Artificial Sequence
  Description of Artificial Sequence: Synthetic peptide
  Seed: YVWKTWGQYWQVLGG (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXGG

SEQ ID NO: 342451 - protein, 16 aa, Artificial Sequence
  Description of Artificial Sequence: Synthetic peptide
  Seed: YVWKTWGQYWQVLGGP (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXGGP

SEQ ID NO: 342452 - protein, 16 aa, Artificial Sequence
  Description of Artificial Sequence: Synthetic peptide
  Seed: YVWKTWGQYWQVLGGP (PMEL_HUMAN)
  Core: WGQYWQVLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTXGQXWXVLXGP

SEQ ID NO: 342453 - protein, 17 aa, Artificial Sequence
  Description of Artificial Sequence: Synthetic peptide
  Seed: YVWKTWGQYWQVLGGPV (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXGGPV

SEQ ID NO: 342454 - protein, 17 aa, Artificial Sequence
  Description of Artificial Sequence: Synthetic peptide
  Seed: YVWKTWGQYWQVLGGPV (PMEL_HUMAN)
  Core: WGQYWQVLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTXGQXWXVLXGPV

SEQ ID NO: 342455 - protein, 17 aa, Artificial Sequence
  Description of Artificial Sequence: Synthetic peptide
  Seed: YVWKTWGQYWQVLGGPV (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPX

SEQ ID NO: 342456 - protein, 18 aa, Artificial Sequence
  Description of Artificial Sequence: Synthetic peptide
  Seed: YVWKTWGQYWQVLGGPVS (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXGGPVS

SEQ ID NO: 342457 - protein, 18 aa, Artificial Sequence
  Description of Artificial Sequence: Synthetic peptide
  Seed: YVWKTWGQYWQVLGGPVS (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVS

SEQ ID NO: 342458 - protein, 18 aa, Artificial Sequence
  Description of Artificial Sequence: Synthetic peptide
  Seed: YVWKTWGQYWQVLGGPVS (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXS

SEQ ID NO: 342459 - protein, 19 aa, Artificial Sequence
  Description of Artificial Sequence: Synthetic peptide
  Seed: YVWKTWGQYWQVLGGPVSG (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSG

SEQ ID NO: 342460 - protein, 19 aa, Artificial Sequence
  Description of Artificial Sequence: Synthetic peptide
  Seed: YVWKTWGQYWQVLGGPVSG (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSG

SEQ ID NO: 342461 - protein, 19 aa, Artificial Sequence
  Description of Artificial Sequence: Synthetic peptide
  Seed: YVWKTWGQYWQVLGGPVSG (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXG

SEQ ID NO: 342462 - protein, 20 aa, Artificial Sequence
  Description of Artificial Sequence: Synthetic peptide
  Seed: YVWKTWGQYWQVLGGPVSGL (PMEL_HUMAN)
  Core: TWGQYWQVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVWKXWGXYXQVXGGPVSGL

SEQ ID NO: 342463 - protein, 20 aa, Artificial Sequence
  Description of Artificial Sequence: Synthetic peptide
  Seed: YVWKTWGQYWQVLGGPVSGL (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGL

SEQ ID NO: 342464 - protein, 20 aa, Artificial Sequence
  Description of Artificial Sequence: Synthetic peptide
  Seed: YVWKTWGQYWQVLGGPVSGL (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGL

SEQ ID NO: 342465 - protein, 20 aa, Artificial Sequence
  Description of Artificial Sequence: Synthetic peptide
  Seed: YVWKTWGQYWQVLGGPVSGL (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGL

SEQ ID NO: 342466 - protein, 21 aa, Artificial Sequence
  Description of Artificial Sequence: Synthetic peptide
  Seed: YVWKTWGQYWQVLGGPVSGLS (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGLS

SEQ ID NO: 342467 - protein, 21 aa, Artificial Sequence
  Description of Artificial Sequence: Synthetic peptide
  Seed: YVWKTWGQYWQVLGGPVSGLS (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGLS

SEQ ID NO: 342468 - protein, 21 aa, Artificial Sequence
  Description of Artificial Sequence: Synthetic peptide
  Seed: YVWKTWGQYWQVLGGPVSGLS (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGLS

SEQ ID NO: 342469 - protein, 21 aa, Artificial Sequence
  Description of Artificial Sequence: Synthetic peptide
  Seed: YVWKTWGQYWQVLGGPVSGLS (PMEL_HUMAN)
  Core: VLGGPVSGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQXLGXPXSGXS

SEQ ID NO: 342470 - protein, 22 aa, Artificial Sequence
  Description of Artificial Sequence: Synthetic peptide
  Seed: YVWKTWGQYWQVLGGPVSGLSI (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGLSI

SEQ ID NO: 342471 - protein, 22 aa, Artificial Sequence
  Description of Artificial Sequence: Synthetic peptide
  Seed: YVWKTWGQYWQVLGGPVSGLSI (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGLSI

SEQ ID NO: 342472 - protein, 22 aa, Artificial Sequence
  Description of Artificial Sequence: Synthetic peptide
  Seed: YVWKTWGQYWQVLGGPVSGLSI (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGLSI

SEQ ID NO: 342473 - protein, 22 aa, Artificial Sequence
  Description of Artificial Sequence: Synthetic peptide
  Seed: YVWKTWGQYWQVLGGPVSGLSI (PMEL_HUMAN)
  Core: VLGGPVSGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQXLGXPXSGXSI

SEQ ID NO: 342474 - protein, 23 aa, Artificial Sequence
  Description of Artificial Sequence: Synthetic peptide
  Seed: YVWKTWGQYWQVLGGPVSGLSIG (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGLSIG

SEQ ID NO: 342475 - protein, 23 aa, Artificial Sequence
  Description of Artificial Sequence: Synthetic peptide
  Seed: YVWKTWGQYWQVLGGPVSGLSIG (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGLSIG

SEQ ID NO: 342476 - protein, 23 aa, Artificial Sequence
  Description of Artificial Sequence: Synthetic peptide
  Seed: YVWKTWGQYWQVLGGPVSGLSIG (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGLSIG

SEQ ID NO: 342477 - protein, 23 aa, Artificial Sequence
  Description of Artificial Sequence: Synthetic peptide
  Seed: YVWKTWGQYWQVLGGPVSGLSIG (PMEL_HUMAN)
  Core: VLGGPVSGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQXLGXPXSGXSIG

SEQ ID NO: 342478 - protein, 24 aa, Artificial Sequence
  Description of Artificial Sequence: Synthetic peptide
  Seed: YVWKTWGQYWQVLGGPVSGLSIGT (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGLSIGT

SEQ ID NO: 342479 - protein, 24 aa, Artificial Sequence
  Description of Artificial Sequence: Synthetic peptide
  Seed: YVWKTWGQYWQVLGGPVSGLSIGT (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGLSIGT

SEQ ID NO: 342480 - protein, 24 aa, Artificial Sequence
  Description of Artificial Sequence: Synthetic peptide
  Seed: YVWKTWGQYWQVLGGPVSGLSIGT (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGLSIGT

SEQ ID NO: 342481 - protein, 24 aa, Artificial Sequence
  Description of Artificial Sequence: Synthetic peptide
  Seed: YVWKTWGQYWQVLGGPVSGLSIGT (PMEL_HUMAN)
  Core: VLGGPVSGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQXLGXPXSGXSIGT

SEQ ID NO: 342482 - protein, 25 aa, Artificial Sequence
  Description of Artificial Sequence: Synthetic peptide
  Seed: YVWKTWGQYWQVLGGPVSGLSIGTG (PMEL_HUMAN)
  Core: GQYWQVLGG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWXQYXQXLGXPVSGLSIGTG

SEQ ID NO: 342483 - protein, 25 aa, Artificial Sequence
  Description of Artificial Sequence: Synthetic peptide
  Seed: YVWKTWGQYWQVLGGPVSGLSIGTG (PMEL_HUMAN)
  Core: YWQVLGGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQXWQXLXGPXSGLSIGTG

SEQ ID NO: 342484 - protein, 25 aa, Artificial Sequence
  Description of Artificial Sequence: Synthetic peptide
  Seed: YVWKTWGQYWQVLGGPVSGLSIGTG (PMEL_HUMAN)
  Core: WQVLGGPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYXQVXGXPVXGLSIGTG

SEQ ID NO: 342485 - protein, 25 aa, Artificial Sequence
  Description of Artificial Sequence: Synthetic peptide
  Seed: YVWKTWGQYWQVLGGPVSGLSIGTG (PMEL_HUMAN)
  Core: VLGGPVSGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQXLGXPXSGXSIGTG

SEQ ID NO: 342486 - protein, 25 aa, Artificial Sequence
  Description of Artificial Sequence: Synthetic peptide
  Seed: YVWKTWGQYWQVLGGPVSGLSIGTG (PMEL_HUMAN)
  Core: PVSGLSIGT
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YVWKTWGQYWQVLGGXVSXLXIGXG

SEQ ID NO: 342487 - protein, 13 aa, Artificial Sequence
  Description of Artificial Sequence: Synthetic peptide
  Seed: YWQVLGGPVSGLS (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLS

SEQ ID NO: 342488 - protein, 13 aa, Artificial Sequence
  Description of Artificial Sequence: Synthetic peptide
  Seed: YWQVLGGPVSGLS (PMEL_HUMAN)
  Core: VLGGPVSGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YWQXLGXPXSGXS

SEQ ID NO: 342489 - protein, 14 aa, Artificial Sequence
  Description of Artificial Sequence: Synthetic peptide
  Seed: YWQVLGGPVSGLSI (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSI

SEQ ID NO: 342490 - protein, 14 aa, Artificial Sequence
  Description of Artificial Sequence: Synthetic peptide
  Seed: YWQVLGGPVSGLSI (PMEL_HUMAN)
  Core: VLGGPVSGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YWQXLGXPXSGXSI

SEQ ID NO: 342491 - protein, 15 aa, Artificial Sequence
  Description of Artificial Sequence: Synthetic peptide
  Seed: YWQVLGGPVSGLSIG (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSIG

SEQ ID NO: 342492 - protein, 15 aa, Artificial Sequence
  Description of Artificial Sequence: Synthetic peptide
  Seed: YWQVLGGPVSGLSIG (PMEL_HUMAN)
  Core: VLGGPVSGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YWQXLGXPXSGXSIG

SEQ ID NO: 342493 - protein, 16 aa, Artificial Sequence
  Description of Artificial Sequence: Synthetic peptide
  Seed: YWQVLGGPVSGLSIGT (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSIGT

SEQ ID NO: 342494 - protein, 16 aa, Artificial Sequence
  Description of Artificial Sequence: Synthetic peptide
  Seed: YWQVLGGPVSGLSIGT (PMEL_HUMAN)
  Core: VLGGPVSGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YWQXLGXPXSGXSIGT

SEQ ID NO: 342495 - protein, 17 aa, Artificial Sequence
  Description of Artificial Sequence: Synthetic peptide
  Seed: YWQVLGGPVSGLSIGTG (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSIGTG

SEQ ID NO: 342496 - protein, 17 aa, Artificial Sequence
  Description of Artificial Sequence: Synthetic peptide
  Seed: YWQVLGGPVSGLSIGTG (PMEL_HUMAN)
  Core: VLGGPVSGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YWQXLGXPXSGXSIGTG

SEQ ID NO: 342497 - protein, 17 aa, Artificial Sequence
  Description of Artificial Sequence: Synthetic peptide
  Seed: YWQVLGGPVSGLSIGTG (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXG

SEQ ID NO: 342498 - protein, 18 aa, Artificial Sequence
  Description of Artificial Sequence: Synthetic peptide
  Seed: YWQVLGGPVSGLSIGTGR (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSIGTGR

SEQ ID NO: 342499 - protein, 18 aa, Artificial Sequence
  Description of Artificial Sequence: Synthetic peptide
  Seed: YWQVLGGPVSGLSIGTGR (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGR

SEQ ID NO: 342500 - protein, 19 aa, Artificial Sequence
  Description of Artificial Sequence: Synthetic peptide
  Seed: YWQVLGGPVSGLSIGTGRA (PMEL_HUMAN)
  Core: WQVLGGPVS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXQVXGXPVXGLSIGTGRA

SEQ ID NO: 342501 - protein, 19 aa, Artificial Sequence
  Description of Artificial Sequence: Synthetic peptide
  Seed: YWQVLGGPVSGLSIGTGRA (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGRA

SEQ ID NO: 342502 - protein, 19 aa, Artificial Sequence
  Description of Artificial Sequence: Synthetic peptide
  Seed: YWQVLGGPVSGLSIGTGRA (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRA

SEQ ID NO: 342503 - protein, 20 aa, Artificial Sequence
  Description of Artificial Sequence: Synthetic peptide
  Seed: YWQVLGGPVSGLSIGTGRAM (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGRAM

SEQ ID NO: 342504 - protein, 20 aa, Artificial Sequence
  Description of Artificial Sequence: Synthetic peptide
  Seed: YWQVLGGPVSGLSIGTGRAM (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAM

SEQ ID NO: 342505 - protein, 20 aa, Artificial Sequence
  Description of Artificial Sequence: Synthetic peptide
  Seed: YWQVLGGPVSGLSIGTGRAM (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAX

SEQ ID NO: 342506 - protein, 21 aa, Artificial Sequence
  Description of Artificial Sequence: Synthetic peptide
  Seed: YWQVLGGPVSGLSIGTGRAML (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGRAML

SEQ ID NO: 342507 - protein, 21 aa, Artificial Sequence
  Description of Artificial Sequence: Synthetic peptide
  Seed: YWQVLGGPVSGLSIGTGRAML (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAML

SEQ ID NO: 342508 - protein, 21 aa, Artificial Sequence
  Description of Artificial Sequence: Synthetic peptide
  Seed: YWQVLGGPVSGLSIGTGRAML (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAXL

SEQ ID NO: 342509 - protein, 22 aa, Artificial Sequence
  Description of Artificial Sequence: Synthetic peptide
  Seed: YWQVLGGPVSGLSIGTGRAMLG (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGRAMLG

SEQ ID NO: 342510 - protein, 22 aa, Artificial Sequence
  Description of Artificial Sequence: Synthetic peptide
  Seed: YWQVLGGPVSGLSIGTGRAMLG (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAMLG

SEQ ID NO: 342511 - protein, 22 aa, Artificial Sequence
  Description of Artificial Sequence: Synthetic peptide
  Seed: YWQVLGGPVSGLSIGTGRAMLG (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAXLG

SEQ ID NO: 342512 - protein, 23 aa, Artificial Sequence
  Description of Artificial Sequence: Synthetic peptide
  Seed: YWQVLGGPVSGLSIGTGRAMLGT (PMEL_HUMAN)
  Core: PVSGLSIGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGXVSXLXIGXGRAMLGT

SEQ ID NO: 342513 - protein, 23 aa, Artificial Sequence
  Description of Artificial Sequence: Synthetic peptide
  Seed: YWQVLGGPVSGLSIGTGRAMLGT (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAMLGT

SEQ ID NO: 342514 - protein, 23 aa, Artificial Sequence
  Description of Artificial Sequence: Synthetic peptide
  Seed: YWQVLGGPVSGLSIGTGRAMLGT (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAXLGT

SEQ ID NO: 342515 - protein, 24 aa, Artificial Sequence
  Description of Artificial Sequence: Synthetic peptide
  Seed: YWQVLGGPVSGLSIGTGRAMLGTH (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAMLGTH

SEQ ID NO: 342516 - protein, 24 aa, Artificial Sequence
  Description of Artificial Sequence: Synthetic peptide
  Seed: YWQVLGGPVSGLSIGTGRAMLGTH (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAXLGTH

SEQ ID NO: 342517 - protein, 24 aa, Artificial Sequence
  Description of Artificial Sequence: Synthetic peptide
  Seed: YWQVLGGPVSGLSIGTGRAMLGTH (PMEL_HUMAN)
  Core: IGTGRAMLG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGLSXGTXRXMLXTH

SEQ ID NO: 342518 - protein, 25 aa, Artificial Sequence
  Description of Artificial Sequence: Synthetic peptide
  Seed: YWQVLGGPVSGLSIGTGRAMLGTHT (PMEL_HUMAN)
  Core: VSGLSIGTG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPXSGXSXGTXRAMLGTHT

SEQ ID NO: 342519 - protein, 25 aa, Artificial Sequence
  Description of Artificial Sequence: Synthetic peptide
  Seed: YWQVLGGPVSGLSIGTGRAMLGTHT (PMEL_HUMAN)
  Core: LSIGTGRAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGXSIXTXRAXLGTHT

SEQ ID NO: 342520 - protein, 25 aa, Artificial Sequence
  Description of Artificial Sequence: Synthetic peptide
  Seed: YWQVLGGPVSGLSIGTGRAMLGTHT (PMEL_HUMAN)
  Core: IGTGRAMLG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YWQVLGGPVSGLSXGTXRXMLXTHT

SEQ ID NO: 342521 - protein, 15 aa, Artificial Sequence
  Description of Artificial Sequence: Synthetic peptide
  Seed: KKLKIFAMPMQDIKM (PRAME_HUMAN)
KKLKFFAAPFQDLKM

SEQ ID NO: 342522 - protein, 15 aa, Artificial Sequence
  Description of Artificial Sequence: Synthetic peptide
  Seed: KKLKIFAMPMQDIKM (PRAME_HUMAN)
KKLKFFAIPFQDVKM

SEQ ID NO: 342523 - protein, 15 aa, Artificial Sequence
  Description of Artificial Sequence: Synthetic peptide
  Seed: KKLKIFAMPMQDIKM (PRAME_HUMAN)
KKLKFFAIPLQDLKM

SEQ ID NO: 342524 - protein, 15 aa, Artificial Sequence
  Description of Artificial Sequence: Synthetic peptide
  Seed: KKLKIFAMPMQDIKM (PRAME_HUMAN)
KKLRIFSMAMQNIKM

SEQ ID NO: 342525 - protein, 15 aa, Artificial Sequence
  Description of Artificial Sequence: Synthetic peptide
  Seed: LERLAYLHARLRELL (PRAME_HUMAN)
LERFAYMHNRLVELL

SEQ ID NO: 342526 - protein, 23 aa, Homo sapiens
  Native (PRAME_HUMAN)
DEALAIAALELLPRELFPPLFMA

SEQ ID NO: 342527 - protein, 15 aa, Homo sapiens
  Native (PRAME_HUMAN)
DQLLRHVMNPLETLS

SEQ ID NO: 342528 - protein, 15 aa, Homo sapiens
  Native (PRAME_HUMAN)
EQYIAQFTSQFLSLQ

SEQ ID NO: 342529 - protein, 20 aa, Homo sapiens
  Native (PRAME_HUMAN)
HGTLHLERLAYLHARLRELL

SEQ ID NO: 342530 - protein, 20 aa, Homo sapiens
  Native (PRAME_HUMAN)
KGQHLHLETFKAVLDGLDVL

SEQ ID NO: 342531 - protein, 15 aa, Homo sapiens
  Native (PRAME_HUMAN)
KKLKIFAMPMQDIKM

SEQ ID NO: 342532 - protein, 15 aa, Homo sapiens
  Native (PRAME_HUMAN)
LDVLLAQEVRPRRWK

SEQ ID NO: 342533 - protein, 15 aa, Homo sapiens
  Native (PRAME_HUMAN)
LFSYLIEKVKRKKNV

SEQ ID NO: 342534 - protein, 15 aa, Homo sapiens
  Native (PRAME_HUMAN)
LGQMINLRRLLLSHI

SEQ ID NO: 342535 - protein, 15 aa, Homo sapiens
  Native (PRAME_HUMAN)
LKAMVQAWPFTCLPL

SEQ ID NO: 342536 - protein, 25 aa, Homo sapiens
  Native (PRAME_HUMAN)
LQDLVFDECGITDDQLLALLPSLSH

SEQ ID NO: 342537 - protein, 25 aa, Homo sapiens
  Native (PRAME_HUMAN)
MERRRLWGSIQSRYISMSVWTSPRR

SEQ ID NO: 342538 - protein, 17 aa, Homo sapiens
  Native (PRAME_HUMAN)
QALYVDSLFFLRGRLDQ

SEQ ID NO: 342539 - protein, 15 aa, Homo sapiens
  Native (PRAME_HUMAN)
QDIKMILKMVQLDSI

SEQ ID NO: 342540 - protein, 15 aa, Homo sapiens
  Native (PRAME_HUMAN)
QLLALLPSLSHCSQL

SEQ ID NO: 342541 - protein, 17 aa, Homo sapiens
  Native (PRAME_HUMAN)
QLTTLSFYGNSISISAL

SEQ ID NO: 342542 - protein, 15 aa, Homo sapiens
  Native (PRAME_HUMAN)
QSLLKDEALAIAALE

SEQ ID NO: 342543 - protein, 20 aa, Homo sapiens
  Native (PRAME_HUMAN)
QSLLQHLIGLSNLTHVLYPV

SEQ ID NO: 342544 - protein, 15 aa, Homo sapiens
  Native (PRAME_HUMAN)
RELLCELGRPSMVWL

SEQ ID NO: 342545 - protein, 17 aa, Homo sapiens
  Native (PRAME_HUMAN)
RKKNVLRLCCKKLKIFA

SEQ ID NO: 342546 - protein, 20 aa, Homo sapiens
  Native (PRAME_HUMAN)
RPSMVWLSANPCPHCGDRTF

SEQ ID NO: 342547 - protein, 20 aa, Homo sapiens
  Native (PRAME_HUMAN)
RRLLLSHIHASSYISPEKEE

SEQ ID NO: 342548 - protein, 15 aa, Homo sapiens
  Native (PRAME_HUMAN)
SISISALQSLLQHLI

SEQ ID NO: 342549 - protein, 15 aa, Homo sapiens
  Native (PRAME_HUMAN)
TCLPLGVLMKGQHLH

SEQ ID NO: 342550 - protein, 23 aa, Homo sapiens
  Native (PRAME_HUMAN)
TEAEQPFIPVEVLVDLFLKEGAC

SEQ ID NO: 342551 - protein, 19 aa, Homo sapiens
  Native (PRAME_HUMAN)
TSQFLSLQCLQALYVDSLF

SEQ ID NO: 342552 - protein, 25 aa, Homo sapiens
  Native (PRAME_HUMAN)
VLVDLFLKEGACDELFSYLIEKVKR

SEQ ID NO: 342553 - protein, 15 aa, Homo sapiens
  Native (PRAME_HUMAN)
VSQLSVLSLSGVMLT

SEQ ID NO: 342554 - protein, 20 aa, Homo sapiens
  Native (PRAME_HUMAN)
WKLPTLAKFSPYLGQMINLR

SEQ ID NO: 342555 - protein, 20 aa, Homo sapiens
  Native (PRAME_HUMAN)
WTSPRRLVELAGQSLLKDEA

SEQ ID NO: 342556 - protein, 15 aa, Homo sapiens
  Native (PRAME_HUMAN)
AAFDGRHSQTLKAMV

SEQ ID NO: 342557 - protein, 16 aa, Homo sapiens
  Native (PRAME_HUMAN)
AAFDGRHSQTLKAMVQ

SEQ ID NO: 342558 - protein, 17 aa, Homo sapiens
  Native (PRAME_HUMAN)
AAFDGRHSQTLKAMVQA

SEQ ID NO: 342559 - protein, 18 aa, Homo sapiens
  Native (PRAME_HUMAN)
AAFDGRHSQTLKAMVQAW

SEQ ID NO: 342560 - protein, 19 aa, Homo sapiens
  Native (PRAME_HUMAN)
AAFDGRHSQTLKAMVQAWP

SEQ ID NO: 342561 - protein, 20 aa, Homo sapiens
  Native (PRAME_HUMAN)
AAFDGRHSQTLKAMVQAWPF

SEQ ID NO: 342562 - protein, 21 aa, Homo sapiens
  Native (PRAME_HUMAN)
AAFDGRHSQTLKAMVQAWPFT

SEQ ID NO: 342563 - protein, 22 aa, Homo sapiens
  Native (PRAME_HUMAN)
AAFDGRHSQTLKAMVQAWPFTC

SEQ ID NO: 342564 - protein, 23 aa, Homo sapiens
  Native (PRAME_HUMAN)
AAFDGRHSQTLKAMVQAWPFTCL

SEQ ID NO: 342565 - protein, 24 aa, Homo sapiens
  Native (PRAME_HUMAN)
AAFDGRHSQTLKAMVQAWPFTCLP

SEQ ID NO: 342566 - protein, 25 aa, Homo sapiens
  Native (PRAME_HUMAN)
AAFDGRHSQTLKAMVQAWPFTCLPL

SEQ ID NO: 342567 - protein, 14 aa, Homo sapiens
  Native (PRAME_HUMAN)
AALELLPRELFPPL

SEQ ID NO: 342568 - protein, 15 aa, Homo sapiens
  Native (PRAME_HUMAN)
AALELLPRELFPPLF

SEQ ID NO: 342569 - protein, 16 aa, Homo sapiens
  Native (PRAME_HUMAN)
AALELLPRELFPPLFM

SEQ ID NO: 342570 - protein, 17 aa, Homo sapiens
  Native (PRAME_HUMAN)
AALELLPRELFPPLFMA

SEQ ID NO: 342571 - protein, 18 aa, Homo sapiens
  Native (PRAME_HUMAN)
AALELLPRELFPPLFMAA

SEQ ID NO: 342572 - protein, 19 aa, Homo sapiens
  Native (PRAME_HUMAN)
AALELLPRELFPPLFMAAF

SEQ ID NO: 342573 - protein, 20 aa, Homo sapiens
  Native (PRAME_HUMAN)
AALELLPRELFPPLFMAAFD

SEQ ID NO: 342574 - protein, 21 aa, Homo sapiens
  Native (PRAME_HUMAN)
AALELLPRELFPPLFMAAFDG

SEQ ID NO: 342575 - protein, 22 aa, Homo sapiens
  Native (PRAME_HUMAN)
AALELLPRELFPPLFMAAFDGR

SEQ ID NO: 342576 - protein, 23 aa, Homo sapiens
  Native (PRAME_HUMAN)
AALELLPRELFPPLFMAAFDGRH

SEQ ID NO: 342577 - protein, 24 aa, Homo sapiens
  Native (PRAME_HUMAN)
AALELLPRELFPPLFMAAFDGRHS

SEQ ID NO: 342578 - protein, 25 aa, Homo sapiens
  Native (PRAME_HUMAN)
AALELLPRELFPPLFMAAFDGRHSQ

SEQ ID NO: 342579 - protein, 15 aa, Homo sapiens
  Native (PRAME_HUMAN)
AAQPMTKKRKVDGLS

SEQ ID NO: 342580 - protein, 17 aa, Homo sapiens
  Native (PRAME_HUMAN)
AAQPMTKKRKVDGLSTE

SEQ ID NO: 342581 - protein, 22 aa, Homo sapiens
  Native (PRAME_HUMAN)
AAQPMTKKRKVDGLSTEAEQPF

SEQ ID NO: 342582 - protein, 23 aa, Homo sapiens
  Native (PRAME_HUMAN)
AAQPMTKKRKVDGLSTEAEQPFI

SEQ ID NO: 342583 - protein, 24 aa, Homo sapiens
  Native (PRAME_HUMAN)
AAQPMTKKRKVDGLSTEAEQPFIP

SEQ ID NO: 342584 - protein, 25 aa, Homo sapiens
  Native (PRAME_HUMAN)
AAQPMTKKRKVDGLSTEAEQPFIPV

SEQ ID NO: 342585 - protein, 13 aa, Homo sapiens
  Native (PRAME_HUMAN)
ACDELFSYLIEKV

SEQ ID NO: 342586 - protein, 14 aa, Homo sapiens
  Native (PRAME_HUMAN)
ACDELFSYLIEKVK

SEQ ID NO: 342587 - protein, 15 aa, Homo sapiens
  Native (PRAME_HUMAN)
ACDELFSYLIEKVKR

SEQ ID NO: 342588 - protein, 16 aa, Homo sapiens
  Native (PRAME_HUMAN)
ACDELFSYLIEKVKRK

SEQ ID NO: 342589 - protein, 17 aa, Homo sapiens
  Native (PRAME_HUMAN)
ACDELFSYLIEKVKRKK

SEQ ID NO: 342590 - protein, 18 aa, Homo sapiens
  Native (PRAME_HUMAN)
ACDELFSYLIEKVKRKKN

SEQ ID NO: 342591 - protein, 19 aa, Homo sapiens
  Native (PRAME_HUMAN)
ACDELFSYLIEKVKRKKNV

SEQ ID NO: 342592 - protein, 20 aa, Homo sapiens
  Native (PRAME_HUMAN)
ACDELFSYLIEKVKRKKNVL

SEQ ID NO: 342593 - protein, 21 aa, Homo sapiens
  Native (PRAME_HUMAN)
ACDELFSYLIEKVKRKKNVLR

SEQ ID NO: 342594 - protein, 22 aa, Homo sapiens
  Native (PRAME_HUMAN)
ACDELFSYLIEKVKRKKNVLRL

SEQ ID NO: 342595 - protein, 23 aa, Homo sapiens
  Native (PRAME_HUMAN)
ACDELFSYLIEKVKRKKNVLRLC

SEQ ID NO: 342596 - protein, 24 aa, Homo sapiens
  Native (PRAME_HUMAN)
ACDELFSYLIEKVKRKKNVLRLCC

SEQ ID NO: 342597 - protein, 25 aa, Homo sapiens
  Native (PRAME_HUMAN)
ACDELFSYLIEKVKRKKNVLRLCCK

SEQ ID NO: 342598 - protein, 13 aa, Homo sapiens
  Native (PRAME_HUMAN)
AEQPFIPVEVLVD

SEQ ID NO: 342599 - protein, 14 aa, Homo sapiens
  Native (PRAME_HUMAN)
AEQPFIPVEVLVDL

SEQ ID NO: 342600 - protein, 15 aa, Homo sapiens
  Native (PRAME_HUMAN)
AEQPFIPVEVLVDLF

SEQ ID NO: 342601 - protein, 16 aa, Homo sapiens
  Native (PRAME_HUMAN)
AEQPFIPVEVLVDLFL

SEQ ID NO: 342602 - protein, 17 aa, Homo sapiens
  Native (PRAME_HUMAN)
AEQPFIPVEVLVDLFLK

SEQ ID NO: 342603 - protein, 18 aa, Homo sapiens
  Native (PRAME_HUMAN)
AEQPFIPVEVLVDLFLKE

SEQ ID NO: 342604 - protein, 19 aa, Homo sapiens
  Native (PRAME_HUMAN)
AEQPFIPVEVLVDLFLKEG

SEQ ID NO: 342605 - protein, 20 aa, Homo sapiens
  Native (PRAME_HUMAN)
AEQPFIPVEVLVDLFLKEGA

SEQ ID NO: 342606 - protein, 21 aa, Homo sapiens
  Native (PRAME_HUMAN)
AEQPFIPVEVLVDLFLKEGAC

SEQ ID NO: 342607 - protein, 22 aa, Homo sapiens
  Native (PRAME_HUMAN)
AEQPFIPVEVLVDLFLKEGACD

SEQ ID NO: 342608 - protein, 23 aa, Homo sapiens
  Native (PRAME_HUMAN)
AEQPFIPVEVLVDLFLKEGACDE

SEQ ID NO: 342609 - protein, 24 aa, Homo sapiens
  Native (PRAME_HUMAN)
AEQPFIPVEVLVDLFLKEGACDEL

SEQ ID NO: 342610 - protein, 25 aa, Homo sapiens
  Native (PRAME_HUMAN)
AEQPFIPVEVLVDLFLKEGACDELF

SEQ ID NO: 342611 - protein, 14 aa, Homo sapiens
  Native (PRAME_HUMAN)
AFDGRHSQTLKAMV

SEQ ID NO: 342612 - protein, 15 aa, Homo sapiens
  Native (PRAME_HUMAN)
AFDGRHSQTLKAMVQ

SEQ ID NO: 342613 - protein, 16 aa, Homo sapiens
  Native (PRAME_HUMAN)
AFDGRHSQTLKAMVQA

SEQ ID NO: 342614 - protein, 17 aa, Homo sapiens
  Native (PRAME_HUMAN)
AFDGRHSQTLKAMVQAW

SEQ ID NO: 342615 - protein, 18 aa, Homo sapiens
  Native (PRAME_HUMAN)
AFDGRHSQTLKAMVQAWP

SEQ ID NO: 342616 - protein, 19 aa, Homo sapiens
  Native (PRAME_HUMAN)
AFDGRHSQTLKAMVQAWPF

SEQ ID NO: 342617 - protein, 20 aa, Homo sapiens
  Native (PRAME_HUMAN)
AFDGRHSQTLKAMVQAWPFT

SEQ ID NO: 342618 - protein, 21 aa, Homo sapiens
  Native (PRAME_HUMAN)
AFDGRHSQTLKAMVQAWPFTC

SEQ ID NO: 342619 - protein, 22 aa, Homo sapiens
  Native (PRAME_HUMAN)
AFDGRHSQTLKAMVQAWPFTCL

SEQ ID NO: 342620 - protein, 23 aa, Homo sapiens
  Native (PRAME_HUMAN)
AFDGRHSQTLKAMVQAWPFTCLP

SEQ ID NO: 342621 - protein, 24 aa, Homo sapiens
  Native (PRAME_HUMAN)
AFDGRHSQTLKAMVQAWPFTCLPL

SEQ ID NO: 342622 - protein, 25 aa, Homo sapiens
  Native (PRAME_HUMAN)
AFDGRHSQTLKAMVQAWPFTCLPLG

SEQ ID NO: 342623 - protein, 13 aa, Homo sapiens
  Native (PRAME_HUMAN)
AGQSLLKDEALAI

SEQ ID NO: 342624 - protein, 14 aa, Homo sapiens
  Native (PRAME_HUMAN)
AGQSLLKDEALAIA

SEQ ID NO: 342625 - protein, 15 aa, Homo sapiens
  Native (PRAME_HUMAN)
AGQSLLKDEALAIAA

SEQ ID NO: 342626 - protein, 16 aa, Homo sapiens
  Native (PRAME_HUMAN)
AGQSLLKDEALAIAAL

SEQ ID NO: 342627 - protein, 17 aa, Homo sapiens
  Native (PRAME_HUMAN)
AGQSLLKDEALAIAALE

SEQ ID NO: 342628 - protein, 18 aa, Homo sapiens
  Native (PRAME_HUMAN)
AGQSLLKDEALAIAALEL

SEQ ID NO: 342629 - protein, 19 aa, Homo sapiens
  Native (PRAME_HUMAN)
AGQSLLKDEALAIAALELL

SEQ ID NO: 342630 - protein, 20 aa, Homo sapiens
  Native (PRAME_HUMAN)
AGQSLLKDEALAIAALELLP

SEQ ID NO: 342631 - protein, 21 aa, Homo sapiens
  Native (PRAME_HUMAN)
AGQSLLKDEALAIAALELLPR

SEQ ID NO: 342632 - protein, 22 aa, Homo sapiens
  Native (PRAME_HUMAN)
AGQSLLKDEALAIAALELLPRE

SEQ ID NO: 342633 - protein, 23 aa, Homo sapiens
  Native (PRAME_HUMAN)
AGQSLLKDEALAIAALELLPREL

SEQ ID NO: 342634 - protein, 24 aa, Homo sapiens
  Native (PRAME_HUMAN)
AGQSLLKDEALAIAALELLPRELF

SEQ ID NO: 342635 - protein, 25 aa, Homo sapiens
  Native (PRAME_HUMAN)
AGQSLLKDEALAIAALELLPRELFP

SEQ ID NO: 342636 - protein, 13 aa, Homo sapiens
  Native (PRAME_HUMAN)
AIAALELLPRELF

SEQ ID NO: 342637 - protein, 14 aa, Homo sapiens
  Native (PRAME_HUMAN)
AIAALELLPRELFP

SEQ ID NO: 342638 - protein, 15 aa, Homo sapiens
  Native (PRAME_HUMAN)
AIAALELLPRELFPP

SEQ ID NO: 342639 - protein, 16 aa, Homo sapiens
  Native (PRAME_HUMAN)
AIAALELLPRELFPPL

SEQ ID NO: 342640 - protein, 17 aa, Homo sapiens
  Native (PRAME_HUMAN)
AIAALELLPRELFPPLF

SEQ ID NO: 342641 - protein, 18 aa, Homo sapiens
  Native (PRAME_HUMAN)
AIAALELLPRELFPPLFM

SEQ ID NO: 342642 - protein, 19 aa, Homo sapiens
  Native (PRAME_HUMAN)
AIAALELLPRELFPPLFMA

SEQ ID NO: 342643 - protein, 20 aa, Homo sapiens
  Native (PRAME_HUMAN)
AIAALELLPRELFPPLFMAA

SEQ ID NO: 342644 - protein, 21 aa, Homo sapiens
  Native (PRAME_HUMAN)
AIAALELLPRELFPPLFMAAF

SEQ ID NO: 342645 - protein, 22 aa, Homo sapiens
  Native (PRAME_HUMAN)
AIAALELLPRELFPPLFMAAFD

SEQ ID NO: 342646 - protein, 23 aa, Homo sapiens
  Native (PRAME_HUMAN)
AIAALELLPRELFPPLFMAAFDG

SEQ ID NO: 342647 - protein, 24 aa, Homo sapiens
  Native (PRAME_HUMAN)
AIAALELLPRELFPPLFMAAFDGR

SEQ ID NO: 342648 - protein, 25 aa, Homo sapiens
  Native (PRAME_HUMAN)
AIAALELLPRELFPPLFMAAFDGRH

SEQ ID NO: 342649 - protein, 13 aa, Homo sapiens
  Native (PRAME_HUMAN)
AKFSPYLGQMINL

SEQ ID NO: 342650 - protein, 14 aa, Homo sapiens
  Native (PRAME_HUMAN)
AKFSPYLGQMINLR

SEQ ID NO: 342651 - protein, 15 aa, Homo sapiens
  Native (PRAME_HUMAN)
AKFSPYLGQMINLRR

SEQ ID NO: 342652 - protein, 16 aa, Homo sapiens
  Native (PRAME_HUMAN)
AKFSPYLGQMINLRRL

SEQ ID NO: 342653 - protein, 17 aa, Homo sapiens
  Native (PRAME_HUMAN)
AKFSPYLGQMINLRRLL

SEQ ID NO: 342654 - protein, 18 aa, Homo sapiens
  Native (PRAME_HUMAN)
AKFSPYLGQMINLRRLLL

SEQ ID NO: 342655 - protein, 19 aa, Homo sapiens
  Native (PRAME_HUMAN)
AKFSPYLGQMINLRRLLLS

SEQ ID NO: 342656 - protein, 20 aa, Homo sapiens
  Native (PRAME_HUMAN)
AKFSPYLGQMINLRRLLLSH

SEQ ID NO: 342657 - protein, 21 aa, Homo sapiens
  Native (PRAME_HUMAN)
AKFSPYLGQMINLRRLLLSHI

SEQ ID NO: 342658 - protein, 22 aa, Homo sapiens
  Native (PRAME_HUMAN)
AKFSPYLGQMINLRRLLLSHIH

SEQ ID NO: 342659 - protein, 23 aa, Homo sapiens
  Native (PRAME_HUMAN)
AKFSPYLGQMINLRRLLLSHIHA

SEQ ID NO: 342660 - protein, 24 aa, Homo sapiens
  Native (PRAME_HUMAN)
AKFSPYLGQMINLRRLLLSHIHAS

SEQ ID NO: 342661 - protein, 25 aa, Homo sapiens
  Native (PRAME_HUMAN)
AKFSPYLGQMINLRRLLLSHIHASS

SEQ ID NO: 342662 - protein, 13 aa, Homo sapiens
  Native (PRAME_HUMAN)
ALAIAALELLPRE

SEQ ID NO: 342663 - protein, 14 aa, Homo sapiens
  Native (PRAME_HUMAN)
ALAIAALELLPREL

SEQ ID NO: 342664 - protein, 15 aa, Homo sapiens
  Native (PRAME_HUMAN)
ALAIAALELLPRELF

SEQ ID NO: 342665 - protein, 16 aa, Homo sapiens
  Native (PRAME_HUMAN)
ALAIAALELLPRELFP

SEQ ID NO: 342666 - protein, 17 aa, Homo sapiens
  Native (PRAME_HUMAN)
ALAIAALELLPRELFPP

SEQ ID NO: 342667 - protein, 18 aa, Homo sapiens
  Native (PRAME_HUMAN)
ALAIAALELLPRELFPPL

SEQ ID NO: 342668 - protein, 19 aa, Homo sapiens
  Native (PRAME_HUMAN)
ALAIAALELLPRELFPPLF

SEQ ID NO: 342669 - protein, 20 aa, Homo sapiens
  Native (PRAME_HUMAN)
ALAIAALELLPRELFPPLFM

SEQ ID NO: 342670 - protein, 21 aa, Homo sapiens
  Native (PRAME_HUMAN)
ALAIAALELLPRELFPPLFMA

SEQ ID NO: 342671 - protein, 22 aa, Homo sapiens
  Native (PRAME_HUMAN)
ALAIAALELLPRELFPPLFMAA

SEQ ID NO: 342672 - protein, 23 aa, Homo sapiens
  Native (PRAME_HUMAN)
ALAIAALELLPRELFPPLFMAAF

SEQ ID NO: 342673 - protein, 24 aa, Homo sapiens
  Native (PRAME_HUMAN)
ALAIAALELLPRELFPPLFMAAFD

SEQ ID NO: 342674 - protein, 25 aa, Homo sapiens
  Native (PRAME_HUMAN)
ALAIAALELLPRELFPPLFMAAFDG

SEQ ID NO: 342675 - protein, 14 aa, Homo sapiens
  Native (PRAME_HUMAN)
ALELLPRELFPPLF

SEQ ID NO: 342676 - protein, 15 aa, Homo sapiens
  Native (PRAME_HUMAN)
ALELLPRELFPPLFM

SEQ ID NO: 342677 - protein, 16 aa, Homo sapiens
  Native (PRAME_HUMAN)
ALELLPRELFPPLFMA

SEQ ID NO: 342678 - protein, 17 aa, Homo sapiens
  Native (PRAME_HUMAN)
ALELLPRELFPPLFMAA

SEQ ID NO: 342679 - protein, 18 aa, Homo sapiens
  Native (PRAME_HUMAN)
ALELLPRELFPPLFMAAF

SEQ ID NO: 342680 - protein, 19 aa, Homo sapiens
  Native (PRAME_HUMAN)
ALELLPRELFPPLFMAAFD

SEQ ID NO: 342681 - protein, 20 aa, Homo sapiens
  Native (PRAME_HUMAN)
ALELLPRELFPPLFMAAFDG

SEQ ID NO: 342682 - protein, 21 aa, Homo sapiens
  Native (PRAME_HUMAN)
ALELLPRELFPPLFMAAFDGR

SEQ ID NO: 342683 - protein, 22 aa, Homo sapiens
  Native (PRAME_HUMAN)
ALELLPRELFPPLFMAAFDGRH

SEQ ID NO: 342684 - protein, 23 aa, Homo sapiens
  Native (PRAME_HUMAN)
ALELLPRELFPPLFMAAFDGRHS

SEQ ID NO: 342685 - protein, 24 aa, Homo sapiens
  Native (PRAME_HUMAN)
ALELLPRELFPPLFMAAFDGRHSQ

SEQ ID NO: 342686 - protein, 25 aa, Homo sapiens
  Native (PRAME_HUMAN)
ALELLPRELFPPLFMAAFDGRHSQT

SEQ ID NO: 342687 - protein, 13 aa, Homo sapiens
  Native (PRAME_HUMAN)
ALLERASATLQDL

SEQ ID NO: 342688 - protein, 14 aa, Homo sapiens
  Native (PRAME_HUMAN)
ALLERASATLQDLV

SEQ ID NO: 342689 - protein, 15 aa, Homo sapiens
  Native (PRAME_HUMAN)
ALLERASATLQDLVF

SEQ ID NO: 342690 - protein, 16 aa, Homo sapiens
  Native (PRAME_HUMAN)
ALLERASATLQDLVFD

SEQ ID NO: 342691 - protein, 17 aa, Homo sapiens
  Native (PRAME_HUMAN)
ALLERASATLQDLVFDE

SEQ ID NO: 342692 - protein, 18 aa, Homo sapiens
  Native (PRAME_HUMAN)
ALLERASATLQDLVFDEC

SEQ ID NO: 342693 - protein, 19 aa, Homo sapiens
  Native (PRAME_HUMAN)
ALLERASATLQDLVFDECG

SEQ ID NO: 342694 - protein, 20 aa, Homo sapiens
  Native (PRAME_HUMAN)
ALLERASATLQDLVFDECGI

SEQ ID NO: 342695 - protein, 21 aa, Homo sapiens
  Native (PRAME_HUMAN)
ALLERASATLQDLVFDECGIT

SEQ ID NO: 342696 - protein, 22 aa, Homo sapiens
  Native (PRAME_HUMAN)
ALLERASATLQDLVFDECGITD

SEQ ID NO: 342697 - protein, 23 aa, Homo sapiens
  Native (PRAME_HUMAN)
ALLERASATLQDLVFDECGITDD

SEQ ID NO: 342698 - protein, 24 aa, Homo sapiens
  Native (PRAME_HUMAN)
ALLERASATLQDLVFDECGITDDQ

SEQ ID NO: 342699 - protein, 25 aa, Homo sapiens
  Native (PRAME_HUMAN)
ALLERASATLQDLVFDECGITDDQL

SEQ ID NO: 342700 - protein, 14 aa, Homo sapiens
  Native (PRAME_HUMAN)
ALLPSLSHCSQLTT

SEQ ID NO: 342701 - protein, 15 aa, Homo sapiens
  Native (PRAME_HUMAN)
ALLPSLSHCSQLTTL

SEQ ID NO: 342702 - protein, 16 aa, Homo sapiens
  Native (PRAME_HUMAN)
ALLPSLSHCSQLTTLS

SEQ ID NO: 342703 - protein, 17 aa, Homo sapiens
  Native (PRAME_HUMAN)
ALLPSLSHCSQLTTLSF

SEQ ID NO: 342704 - protein, 19 aa, Homo sapiens
  Native (PRAME_HUMAN)
ALLPSLSHCSQLTTLSFYG

SEQ ID NO: 342705 - protein, 20 aa, Homo sapiens
  Native (PRAME_HUMAN)
ALLPSLSHCSQLTTLSFYGN

SEQ ID NO: 342706 - protein, 21 aa, Homo sapiens
  Native (PRAME_HUMAN)
ALLPSLSHCSQLTTLSFYGNS

SEQ ID NO: 342707 - protein, 22 aa, Homo sapiens
  Native (PRAME_HUMAN)
ALLPSLSHCSQLTTLSFYGNSI

SEQ ID NO: 342708 - protein, 23 aa, Homo sapiens
  Native (PRAME_HUMAN)
ALLPSLSHCSQLTTLSFYGNSIS

SEQ ID NO: 342709 - protein, 24 aa, Homo sapiens
  Native (PRAME_HUMAN)
ALLPSLSHCSQLTTLSFYGNSISI

SEQ ID NO: 342710 - protein, 25 aa, Homo sapiens
  Native (PRAME_HUMAN)
ALLPSLSHCSQLTTLSFYGNSISIS

SEQ ID NO: 342711 - protein, 13 aa, Homo sapiens
  Native (PRAME_HUMAN)
ALQSLLQHLIGLS

SEQ ID NO: 342712 - protein, 14 aa, Homo sapiens
  Native (PRAME_HUMAN)
ALQSLLQHLIGLSN

SEQ ID NO: 342713 - protein, 15 aa, Homo sapiens
  Native (PRAME_HUMAN)
ALQSLLQHLIGLSNL

SEQ ID NO: 342714 - protein, 16 aa, Homo sapiens
  Native (PRAME_HUMAN)
ALQSLLQHLIGLSNLT

SEQ ID NO: 342715 - protein, 17 aa, Homo sapiens
  Native (PRAME_HUMAN)
ALQSLLQHLIGLSNLTH

SEQ ID NO: 342716 - protein, 18 aa, Homo sapiens
  Native (PRAME_HUMAN)
ALQSLLQHLIGLSNLTHV

SEQ ID NO: 342717 - protein, 19 aa, Homo sapiens
  Native (PRAME_HUMAN)
ALQSLLQHLIGLSNLTHVL

SEQ ID NO: 342718 - protein, 20 aa, Homo sapiens
  Native (PRAME_HUMAN)
ALQSLLQHLIGLSNLTHVLY

SEQ ID NO: 342719 - protein, 21 aa, Homo sapiens
  Native (PRAME_HUMAN)
ALQSLLQHLIGLSNLTHVLYP

SEQ ID NO: 342720 - protein, 22 aa, Homo sapiens
  Native (PRAME_HUMAN)
ALQSLLQHLIGLSNLTHVLYPV

SEQ ID NO: 342721 - protein, 23 aa, Homo sapiens
  Native (PRAME_HUMAN)
ALQSLLQHLIGLSNLTHVLYPVP

SEQ ID NO: 342722 - protein, 24 aa, Homo sapiens
  Native (PRAME_HUMAN)
ALQSLLQHLIGLSNLTHVLYPVPL

SEQ ID NO: 342723 - protein, 25 aa, Homo sapiens
  Native (PRAME_HUMAN)
ALQSLLQHLIGLSNLTHVLYPVPLE

SEQ ID NO: 342724 - protein, 13 aa, Homo sapiens
  Native (PRAME_HUMAN)
ALYVDSLFFLRGR

SEQ ID NO: 342725 - protein, 14 aa, Homo sapiens
  Native (PRAME_HUMAN)
ALYVDSLFFLRGRL

SEQ ID NO: 342726 - protein, 15 aa, Homo sapiens
  Native (PRAME_HUMAN)
ALYVDSLFFLRGRLD

SEQ ID NO: 342727 - protein, 16 aa, Homo sapiens
  Native (PRAME_HUMAN)
ALYVDSLFFLRGRLDQ

SEQ ID NO: 342728 - protein, 17 aa, Homo sapiens
  Native (PRAME_HUMAN)
ALYVDSLFFLRGRLDQL

SEQ ID NO: 342729 - protein, 18 aa, Homo sapiens
  Native (PRAME_HUMAN)
ALYVDSLFFLRGRLDQLL

SEQ ID NO: 342730 - protein, 19 aa, Homo sapiens
  Native (PRAME_HUMAN)
ALYVDSLFFLRGRLDQLLR

SEQ ID NO: 342731 - protein, 20 aa, Homo sapiens
  Native (PRAME_HUMAN)
ALYVDSLFFLRGRLDQLLRH

SEQ ID NO: 342732 - protein, 21 aa, Homo sapiens
  Native (PRAME_HUMAN)
ALYVDSLFFLRGRLDQLLRHV

SEQ ID NO: 342733 - protein, 22 aa, Homo sapiens
  Native (PRAME_HUMAN)
ALYVDSLFFLRGRLDQLLRHVM

SEQ ID NO: 342734 - protein, 23 aa, Homo sapiens
  Native (PRAME_HUMAN)
ALYVDSLFFLRGRLDQLLRHVMN

SEQ ID NO: 342735 - protein, 24 aa, Homo sapiens
  Native (PRAME_HUMAN)
ALYVDSLFFLRGRLDQLLRHVMNP

SEQ ID NO: 342736 - protein, 25 aa, Homo sapiens
  Native (PRAME_HUMAN)
ALYVDSLFFLRGRLDQLLRHVMNPL

SEQ ID NO: 342737 - protein, 14 aa, Homo sapiens
  Native (PRAME_HUMAN)
AMPMQDIKMILKMV

SEQ ID NO: 342738 - protein, 15 aa, Homo sapiens
  Native (PRAME_HUMAN)
AMPMQDIKMILKMVQ

SEQ ID NO: 342739 - protein, 16 aa, Homo sapiens
  Native (PRAME_HUMAN)
AMPMQDIKMILKMVQL

SEQ ID NO: 342740 - protein, 17 aa, Homo sapiens
  Native (PRAME_HUMAN)
AMPMQDIKMILKMVQLD

SEQ ID NO: 342741 - protein, 18 aa, Homo sapiens
  Native (PRAME_HUMAN)
AMPMQDIKMILKMVQLDS

SEQ ID NO: 342742 - protein, 19 aa, Homo sapiens
  Native (PRAME_HUMAN)
AMPMQDIKMILKMVQLDSI

SEQ ID NO: 342743 - protein, 20 aa, Homo sapiens
  Native (PRAME_HUMAN)
AMPMQDIKMILKMVQLDSIE

SEQ ID NO: 342744 - protein, 21 aa, Homo sapiens
  Native (PRAME_HUMAN)
AMPMQDIKMILKMVQLDSIED

SEQ ID NO: 342745 - protein, 22 aa, Homo sapiens
  Native (PRAME_HUMAN)
AMPMQDIKMILKMVQLDSIEDL

SEQ ID NO: 342746 - protein, 23 aa, Homo sapiens
  Native (PRAME_HUMAN)
AMPMQDIKMILKMVQLDSIEDLE

SEQ ID NO: 342747 - protein, 24 aa, Homo sapiens
  Native (PRAME_HUMAN)
AMPMQDIKMILKMVQLDSIEDLEV

SEQ ID NO: 342748 - protein, 25 aa, Homo sapiens
  Native (PRAME_HUMAN)
AMPMQDIKMILKMVQLDSIEDLEVT

SEQ ID NO: 342749 - protein, 13 aa, Homo sapiens
  Native (PRAME_HUMAN)
AMVQAWPFTCLPL

SEQ ID NO: 342750 - protein, 14 aa, Homo sapiens
  Native (PRAME_HUMAN)
AMVQAWPFTCLPLG

SEQ ID NO: 342751 - protein, 15 aa, Homo sapiens
  Native (PRAME_HUMAN)
AMVQAWPFTCLPLGV

SEQ ID NO: 342752 - protein, 16 aa, Homo sapiens
  Native (PRAME_HUMAN)
AMVQAWPFTCLPLGVL

SEQ ID NO: 342753 - protein, 17 aa, Homo sapiens
  Native (PRAME_HUMAN)
AMVQAWPFTCLPLGVLM

SEQ ID NO: 342754 - protein, 18 aa, Homo sapiens
  Native (PRAME_HUMAN)
AMVQAWPFTCLPLGVLMK

SEQ ID NO: 342755 - protein, 19 aa, Homo sapiens
  Native (PRAME_HUMAN)
AMVQAWPFTCLPLGVLMKG

SEQ ID NO: 342756 - protein, 20 aa, Homo sapiens
  Native (PRAME_HUMAN)
AMVQAWPFTCLPLGVLMKGQ

SEQ ID NO: 342757 - protein, 21 aa, Homo sapiens
  Native (PRAME_HUMAN)
AMVQAWPFTCLPLGVLMKGQH

SEQ ID NO: 342758 - protein, 22 aa, Homo sapiens
  Native (PRAME_HUMAN)
AMVQAWPFTCLPLGVLMKGQHL

SEQ ID NO: 342759 - protein, 23 aa, Homo sapiens
  Native (PRAME_HUMAN)
AMVQAWPFTCLPLGVLMKGQHLH

SEQ ID NO: 342760 - protein, 24 aa, Homo sapiens
  Native (PRAME_HUMAN)
AMVQAWPFTCLPLGVLMKGQHLHL

SEQ ID NO: 342761 - protein, 25 aa, Homo sapiens
  Native (PRAME_HUMAN)
AMVQAWPFTCLPLGVLMKGQHLHLE

SEQ ID NO: 342762 - protein, 15 aa, Homo sapiens
  Native (PRAME_HUMAN)
AQEVRPRRWKLQVLD

SEQ ID NO: 342763 - protein, 16 aa, Homo sapiens
  Native (PRAME_HUMAN)
AQEVRPRRWKLQVLDL

SEQ ID NO: 342764 - protein, 17 aa, Homo sapiens
  Native (PRAME_HUMAN)
AQEVRPRRWKLQVLDLR

SEQ ID NO: 342765 - protein, 18 aa, Homo sapiens
  Native (PRAME_HUMAN)
AQEVRPRRWKLQVLDLRK

SEQ ID NO: 342766 - protein, 19 aa, Homo sapiens
  Native (PRAME_HUMAN)
AQEVRPRRWKLQVLDLRKN

SEQ ID NO: 342767 - protein, 20 aa, Homo sapiens
  Native (PRAME_HUMAN)
AQEVRPRRWKLQVLDLRKNS

SEQ ID NO: 342768 - protein, 21 aa, Homo sapiens
  Native (PRAME_HUMAN)
AQEVRPRRWKLQVLDLRKNSH

SEQ ID NO: 342769 - protein, 22 aa, Homo sapiens
  Native (PRAME_HUMAN)
AQEVRPRRWKLQVLDLRKNSHQ

SEQ ID NO: 342770 - protein, 23 aa, Homo sapiens
  Native (PRAME_HUMAN)
AQEVRPRRWKLQVLDLRKNSHQD

SEQ ID NO: 342771 - protein, 24 aa, Homo sapiens
  Native (PRAME_HUMAN)
AQEVRPRRWKLQVLDLRKNSHQDF

SEQ ID NO: 342772 - protein, 25 aa, Homo sapiens
  Native (PRAME_HUMAN)
AQEVRPRRWKLQVLDLRKNSHQDFW

SEQ ID NO: 342773 - protein, 13 aa, Homo sapiens
  Native (PRAME_HUMAN)
AQFTSQFLSLQCL

SEQ ID NO: 342774 - protein, 14 aa, Homo sapiens
  Native (PRAME_HUMAN)
AQFTSQFLSLQCLQ

SEQ ID NO: 342775 - protein, 15 aa, Homo sapiens
  Native (PRAME_HUMAN)
AQFTSQFLSLQCLQA

SEQ ID NO: 342776 - protein, 16 aa, Homo sapiens
  Native (PRAME_HUMAN)
AQFTSQFLSLQCLQAL

SEQ ID NO: 342777 - protein, 17 aa, Homo sapiens
  Native (PRAME_HUMAN)
AQFTSQFLSLQCLQALY

SEQ ID NO: 342778 - protein, 18 aa, Homo sapiens
  Native (PRAME_HUMAN)
AQFTSQFLSLQCLQALYV

SEQ ID NO: 342779 - protein, 19 aa, Homo sapiens
  Native (PRAME_HUMAN)
AQFTSQFLSLQCLQALYVD

SEQ ID NO: 342780 - protein, 20 aa, Homo sapiens
  Native (PRAME_HUMAN)
AQFTSQFLSLQCLQALYVDS

SEQ ID NO: 342781 - protein, 21 aa, Homo sapiens
  Native (PRAME_HUMAN)
AQFTSQFLSLQCLQALYVDSL

SEQ ID NO: 342782 - protein, 22 aa, Homo sapiens
  Native (PRAME_HUMAN)
AQFTSQFLSLQCLQALYVDSLF

SEQ ID NO: 342783 - protein, 23 aa, Homo sapiens
  Native (PRAME_HUMAN)
AQFTSQFLSLQCLQALYVDSLFF

SEQ ID NO: 342784 - protein, 24 aa, Homo sapiens
  Native (PRAME_HUMAN)
AQFTSQFLSLQCLQALYVDSLFFL

SEQ ID NO: 342785 - protein, 25 aa, Homo sapiens
  Native (PRAME_HUMAN)
AQFTSQFLSLQCLQALYVDSLFFLR

SEQ ID NO: 342786 - protein, 15 aa, Homo sapiens
  Native (PRAME_HUMAN)
AQPMTKKRKVDGLST

SEQ ID NO: 342787 - protein, 20 aa, Homo sapiens
  Native (PRAME_HUMAN)
AQPMTKKRKVDGLSTEAEQP

SEQ ID NO: 342788 - protein, 21 aa, Homo sapiens
  Native (PRAME_HUMAN)
AQPMTKKRKVDGLSTEAEQPF

SEQ ID NO: 342789 - protein, 22 aa, Homo sapiens
  Native (PRAME_HUMAN)
AQPMTKKRKVDGLSTEAEQPFI

SEQ ID NO: 342790 - protein, 23 aa, Homo sapiens
  Native (PRAME_HUMAN)
AQPMTKKRKVDGLSTEAEQPFIP

SEQ ID NO: 342791 - protein, 24 aa, Homo sapiens
  Native (PRAME_HUMAN)
AQPMTKKRKVDGLSTEAEQPFIPV

SEQ ID NO: 342792 - protein, 25 aa, Homo sapiens
  Native (PRAME_HUMAN)
AQPMTKKRKVDGLSTEAEQPFIPVE

SEQ ID NO: 342793 - protein, 14 aa, Homo sapiens
  Native (PRAME_HUMAN)
ARLRELLCELGRPS

SEQ ID NO: 342794 - protein, 15 aa, Homo sapiens
  Native (PRAME_HUMAN)
ARLRELLCELGRPSM

SEQ ID NO: 342795 - protein, 16 aa, Homo sapiens
  Native (PRAME_HUMAN)
ARLRELLCELGRPSMV

SEQ ID NO: 342796 - protein, 17 aa, Homo sapiens
  Native (PRAME_HUMAN)
ARLRELLCELGRPSMVW

SEQ ID NO: 342797 - protein, 18 aa, Homo sapiens
  Native (PRAME_HUMAN)
ARLRELLCELGRPSMVWL

SEQ ID NO: 342798 - protein, 19 aa, Homo sapiens
  Native (PRAME_HUMAN)
ARLRELLCELGRPSMVWLS

SEQ ID NO: 342799 - protein, 20 aa, Homo sapiens
  Native (PRAME_HUMAN)
ARLRELLCELGRPSMVWLSA

SEQ ID NO: 342800 - protein, 21 aa, Homo sapiens
  Native (PRAME_HUMAN)
ARLRELLCELGRPSMVWLSAN

SEQ ID NO: 342801 - protein, 22 aa, Homo sapiens
  Native (PRAME_HUMAN)
ARLRELLCELGRPSMVWLSANP

SEQ ID NO: 342802 - protein, 23 aa, Homo sapiens
  Native (PRAME_HUMAN)
ARLRELLCELGRPSMVWLSANPC

SEQ ID NO: 342803 - protein, 24 aa, Homo sapiens
  Native (PRAME_HUMAN)
ARLRELLCELGRPSMVWLSANPCP

SEQ ID NO: 342804 - protein, 25 aa, Homo sapiens
  Native (PRAME_HUMAN)
ARLRELLCELGRPSMVWLSANPCPH

SEQ ID NO: 342805 - protein, 15 aa, Homo sapiens
  Native (PRAME_HUMAN)
ASATLQDLVFDECGI

SEQ ID NO: 342806 - protein, 16 aa, Homo sapiens
  Native (PRAME_HUMAN)
ASATLQDLVFDECGIT

SEQ ID NO: 342807 - protein, 17 aa, Homo sapiens
  Native (PRAME_HUMAN)
ASATLQDLVFDECGITD

SEQ ID NO: 342808 - protein, 19 aa, Homo sapiens
  Native (PRAME_HUMAN)
ASATLQDLVFDECGITDDQ

SEQ ID NO: 342809 - protein, 20 aa, Homo sapiens
  Native (PRAME_HUMAN)
ASATLQDLVFDECGITDDQL

SEQ ID NO: 342810 - protein, 23 aa, Homo sapiens
  Native (PRAME_HUMAN)
ASATLQDLVFDECGITDDQLLAL

SEQ ID NO: 342811 - protein, 24 aa, Homo sapiens
  Native (PRAME_HUMAN)
ASATLQDLVFDECGITDDQLLALL

SEQ ID NO: 342812 - protein, 25 aa, Homo sapiens
  Native (PRAME_HUMAN)
ASATLQDLVFDECGITDDQLLALLP

SEQ ID NO: 342813 - protein, 15 aa, Homo sapiens
  Native (PRAME_HUMAN)
ASLYSFPEPEAAQPM

SEQ ID NO: 342814 - protein, 17 aa, Homo sapiens
  Native (PRAME_HUMAN)
ASLYSFPEPEAAQPMTK

SEQ ID NO: 342815 - protein, 19 aa, Homo sapiens
  Native (PRAME_HUMAN)
ASLYSFPEPEAAQPMTKKR

SEQ ID NO: 342816 - protein, 20 aa, Homo sapiens
  Native (PRAME_HUMAN)
ASLYSFPEPEAAQPMTKKRK

SEQ ID NO: 342817 - protein, 20 aa, Homo sapiens
  Native (PRAME_HUMAN)
ASSYISPEKEEQYIAQFTSQ

SEQ ID NO: 342818 - protein, 21 aa, Homo sapiens
  Native (PRAME_HUMAN)
ASSYISPEKEEQYIAQFTSQF

SEQ ID NO: 342819 - protein, 22 aa, Homo sapiens
  Native (PRAME_HUMAN)
ASSYISPEKEEQYIAQFTSQFL

SEQ ID NO: 342820 - protein, 23 aa, Homo sapiens
  Native (PRAME_HUMAN)
ASSYISPEKEEQYIAQFTSQFLS

SEQ ID NO: 342821 - protein, 24 aa, Homo sapiens
  Native (PRAME_HUMAN)
ASSYISPEKEEQYIAQFTSQFLSL

SEQ ID NO: 342822 - protein, 25 aa, Homo sapiens
  Native (PRAME_HUMAN)
ASSYISPEKEEQYIAQFTSQFLSLQ

SEQ ID NO: 342823 - protein, 20 aa, Homo sapiens
  Native (PRAME_HUMAN)
ATLQDLVFDECGITDDQLLA

SEQ ID NO: 342824 - protein, 21 aa, Homo sapiens
  Native (PRAME_HUMAN)
ATLQDLVFDECGITDDQLLAL

SEQ ID NO: 342825 - protein, 22 aa, Homo sapiens
  Native (PRAME_HUMAN)
ATLQDLVFDECGITDDQLLALL

SEQ ID NO: 342826 - protein, 23 aa, Homo sapiens
  Native (PRAME_HUMAN)
ATLQDLVFDECGITDDQLLALLP

SEQ ID NO: 342827 - protein, 24 aa, Homo sapiens
  Native (PRAME_HUMAN)
ATLQDLVFDECGITDDQLLALLPS

SEQ ID NO: 342828 - protein, 25 aa, Homo sapiens
  Native (PRAME_HUMAN)
ATLQDLVFDECGITDDQLLALLPSL

SEQ ID NO: 342829 - protein, 13 aa, Homo sapiens
  Native (PRAME_HUMAN)
AVLDGLDVLLAQE

SEQ ID NO: 342830 - protein, 14 aa, Homo sapiens
  Native (PRAME_HUMAN)
AVLDGLDVLLAQEV

SEQ ID NO: 342831 - protein, 15 aa, Homo sapiens
  Native (PRAME_HUMAN)
AVLDGLDVLLAQEVR

SEQ ID NO: 342832 - protein, 16 aa, Homo sapiens
  Native (PRAME_HUMAN)
AVLDGLDVLLAQEVRP

SEQ ID NO: 342833 - protein, 17 aa, Homo sapiens
  Native (PRAME_HUMAN)
AVLDGLDVLLAQEVRPR

SEQ ID NO: 342834 - protein, 18 aa, Homo sapiens
  Native (PRAME_HUMAN)
AVLDGLDVLLAQEVRPRR

SEQ ID NO: 342835 - protein, 19 aa, Homo sapiens
  Native (PRAME_HUMAN)
AVLDGLDVLLAQEVRPRRW

SEQ ID NO: 342836 - protein, 20 aa, Homo sapiens
  Native (PRAME_HUMAN)
AVLDGLDVLLAQEVRPRRWK

SEQ ID NO: 342837 - protein, 21 aa, Homo sapiens
  Native (PRAME_HUMAN)
AVLDGLDVLLAQEVRPRRWKL

SEQ ID NO: 342838 - protein, 22 aa, Homo sapiens
  Native (PRAME_HUMAN)
AVLDGLDVLLAQEVRPRRWKLQ

SEQ ID NO: 342839 - protein, 23 aa, Homo sapiens
  Native (PRAME_HUMAN)
AVLDGLDVLLAQEVRPRRWKLQV

SEQ ID NO: 342840 - protein, 24 aa, Homo sapiens
  Native (PRAME_HUMAN)
AVLDGLDVLLAQEVRPRRWKLQVL

SEQ ID NO: 342841 - protein, 25 aa, Homo sapiens
  Native (PRAME_HUMAN)
AVLDGLDVLLAQEVRPRRWKLQVLD

SEQ ID NO: 342842 - protein, 13 aa, Homo sapiens
  Native (PRAME_HUMAN)
AWPFTCLPLGVLM

SEQ ID NO: 342843 - protein, 14 aa, Homo sapiens
  Native (PRAME_HUMAN)
AWPFTCLPLGVLMK

SEQ ID NO: 342844 - protein, 15 aa, Homo sapiens
  Native (PRAME_HUMAN)
AWPFTCLPLGVLMKG

SEQ ID NO: 342845 - protein, 16 aa, Homo sapiens
  Native (PRAME_HUMAN)
AWPFTCLPLGVLMKGQ

SEQ ID NO: 342846 - protein, 17 aa, Homo sapiens
  Native (PRAME_HUMAN)
AWPFTCLPLGVLMKGQH

SEQ ID NO: 342847 - protein, 18 aa, Homo sapiens
  Native (PRAME_HUMAN)
AWPFTCLPLGVLMKGQHL

SEQ ID NO: 342848 - protein, 19 aa, Homo sapiens
  Native (PRAME_HUMAN)
AWPFTCLPLGVLMKGQHLH

SEQ ID NO: 342849 - protein, 20 aa, Homo sapiens
  Native (PRAME_HUMAN)
AWPFTCLPLGVLMKGQHLHL

SEQ ID NO: 342850 - protein, 21 aa, Homo sapiens
  Native (PRAME_HUMAN)
AWPFTCLPLGVLMKGQHLHLE

SEQ ID NO: 342851 - protein, 22 aa, Homo sapiens
  Native (PRAME_HUMAN)
AWPFTCLPLGVLMKGQHLHLET

SEQ ID NO: 342852 - protein, 23 aa, Homo sapiens
  Native (PRAME_HUMAN)
AWPFTCLPLGVLMKGQHLHLETF

SEQ ID NO: 342853 - protein, 24 aa, Homo sapiens
  Native (PRAME_HUMAN)
AWPFTCLPLGVLMKGQHLHLETFK

SEQ ID NO: 342854 - protein, 25 aa, Homo sapiens
  Native (PRAME_HUMAN)
AWPFTCLPLGVLMKGQHLHLETFKA

SEQ ID NO: 342855 - protein, 13 aa, Homo sapiens
  Native (PRAME_HUMAN)
AYLHARLRELLCE

SEQ ID NO: 342856 - protein, 14 aa, Homo sapiens
  Native (PRAME_HUMAN)
AYLHARLRELLCEL

SEQ ID NO: 342857 - protein, 15 aa, Homo sapiens
  Native (PRAME_HUMAN)
AYLHARLRELLCELG

SEQ ID NO: 342858 - protein, 16 aa, Homo sapiens
  Native (PRAME_HUMAN)
AYLHARLRELLCELGR

SEQ ID NO: 342859 - protein, 17 aa, Homo sapiens
  Native (PRAME_HUMAN)
AYLHARLRELLCELGRP

SEQ ID NO: 342860 - protein, 18 aa, Homo sapiens
  Native (PRAME_HUMAN)
AYLHARLRELLCELGRPS

SEQ ID NO: 342861 - protein, 19 aa, Homo sapiens
  Native (PRAME_HUMAN)
AYLHARLRELLCELGRPSM

SEQ ID NO: 342862 - protein, 20 aa, Homo sapiens
  Native (PRAME_HUMAN)
AYLHARLRELLCELGRPSMV

SEQ ID NO: 342863 - protein, 21 aa, Homo sapiens
  Native (PRAME_HUMAN)
AYLHARLRELLCELGRPSMVW

SEQ ID NO: 342864 - protein, 22 aa, Homo sapiens
  Native (PRAME_HUMAN)
AYLHARLRELLCELGRPSMVWL

SEQ ID NO: 342865 - protein, 23 aa, Homo sapiens
  Native (PRAME_HUMAN)
AYLHARLRELLCELGRPSMVWLS

SEQ ID NO: 342866 - protein, 24 aa, Homo sapiens
  Native (PRAME_HUMAN)
AYLHARLRELLCELGRPSMVWLSA

SEQ ID NO: 342867 - protein, 25 aa, Homo sapiens
  Native (PRAME_HUMAN)
AYLHARLRELLCELGRPSMVWLSAN

SEQ ID NO: 342868 - protein, 13 aa, Homo sapiens
  Native (PRAME_HUMAN)
CCKKLKIFAMPMQ

SEQ ID NO: 342869 - protein, 14 aa, Homo sapiens
  Native (PRAME_HUMAN)
CCKKLKIFAMPMQD

SEQ ID NO: 342870 - protein, 15 aa, Homo sapiens
  Native (PRAME_HUMAN)
CCKKLKIFAMPMQDI

SEQ ID NO: 342871 - protein, 16 aa, Homo sapiens
  Native (PRAME_HUMAN)
CCKKLKIFAMPMQDIK

SEQ ID NO: 342872 - protein, 17 aa, Homo sapiens
  Native (PRAME_HUMAN)
CCKKLKIFAMPMQDIKM

SEQ ID NO: 342873 - protein, 18 aa, Homo sapiens
  Native (PRAME_HUMAN)
CCKKLKIFAMPMQDIKMI

SEQ ID NO: 342874 - protein, 19 aa, Homo sapiens
  Native (PRAME_HUMAN)
CCKKLKIFAMPMQDIKMIL

SEQ ID NO: 342875 - protein, 20 aa, Homo sapiens
  Native (PRAME_HUMAN)
CCKKLKIFAMPMQDIKMILK

SEQ ID NO: 342876 - protein, 21 aa, Homo sapiens
  Native (PRAME_HUMAN)
CCKKLKIFAMPMQDIKMILKM

SEQ ID NO: 342877 - protein, 22 aa, Homo sapiens
  Native (PRAME_HUMAN)
CCKKLKIFAMPMQDIKMILKMV

SEQ ID NO: 342878 - protein, 23 aa, Homo sapiens
  Native (PRAME_HUMAN)
CCKKLKIFAMPMQDIKMILKMVQ

SEQ ID NO: 342879 - protein, 24 aa, Homo sapiens
  Native (PRAME_HUMAN)
CCKKLKIFAMPMQDIKMILKMVQL

SEQ ID NO: 342880 - protein, 25 aa, Homo sapiens
  Native (PRAME_HUMAN)
CCKKLKIFAMPMQDIKMILKMVQLD

SEQ ID NO: 342881 - protein, 13 aa, Homo sapiens
  Native (PRAME_HUMAN)
CDELFSYLIEKVK

SEQ ID NO: 342882 - protein, 14 aa, Homo sapiens
  Native (PRAME_HUMAN)
CDELFSYLIEKVKR

SEQ ID NO: 342883 - protein, 15 aa, Homo sapiens
  Native (PRAME_HUMAN)
CDELFSYLIEKVKRK

SEQ ID NO: 342884 - protein, 16 aa, Homo sapiens
  Native (PRAME_HUMAN)
CDELFSYLIEKVKRKK

SEQ ID NO: 342885 - protein, 17 aa, Homo sapiens
  Native (PRAME_HUMAN)
CDELFSYLIEKVKRKKN

SEQ ID NO: 342886 - protein, 18 aa, Homo sapiens
  Native (PRAME_HUMAN)
CDELFSYLIEKVKRKKNV

SEQ ID NO: 342887 - protein, 19 aa, Homo sapiens
  Native (PRAME_HUMAN)
CDELFSYLIEKVKRKKNVL

SEQ ID NO: 342888 - protein, 20 aa, Homo sapiens
  Native (PRAME_HUMAN)
CDELFSYLIEKVKRKKNVLR

SEQ ID NO: 342889 - protein, 21 aa, Homo sapiens
  Native (PRAME_HUMAN)
CDELFSYLIEKVKRKKNVLRL

SEQ ID NO: 342890 - protein, 22 aa, Homo sapiens
  Native (PRAME_HUMAN)
CDELFSYLIEKVKRKKNVLRLC

SEQ ID NO: 342891 - protein, 23 aa, Homo sapiens
  Native (PRAME_HUMAN)
CDELFSYLIEKVKRKKNVLRLCC

SEQ ID NO: 342892 - protein, 24 aa, Homo sapiens
  Native (PRAME_HUMAN)
CDELFSYLIEKVKRKKNVLRLCCK

SEQ ID NO: 342893 - protein, 25 aa, Homo sapiens
  Native (PRAME_HUMAN)
CDELFSYLIEKVKRKKNVLRLCCKK

SEQ ID NO: 342894 - protein, 13 aa, Homo sapiens
  Native (PRAME_HUMAN)
CELGRPSMVWLSA

SEQ ID NO: 342895 - protein, 14 aa, Homo sapiens
  Native (PRAME_HUMAN)
CELGRPSMVWLSAN

SEQ ID NO: 342896 - protein, 15 aa, Homo sapiens
  Native (PRAME_HUMAN)
CELGRPSMVWLSANP

SEQ ID NO: 342897 - protein, 16 aa, Homo sapiens
  Native (PRAME_HUMAN)
CELGRPSMVWLSANPC

SEQ ID NO: 342898 - protein, 17 aa, Homo sapiens
  Native (PRAME_HUMAN)
CELGRPSMVWLSANPCP

SEQ ID NO: 342899 - protein, 18 aa, Homo sapiens
  Native (PRAME_HUMAN)
CELGRPSMVWLSANPCPH

SEQ ID NO: 342900 - protein, 19 aa, Homo sapiens
  Native (PRAME_HUMAN)
CELGRPSMVWLSANPCPHC

SEQ ID NO: 342901 - protein, 20 aa, Homo sapiens
  Native (PRAME_HUMAN)
CELGRPSMVWLSANPCPHCG

SEQ ID NO: 342902 - protein, 21 aa, Homo sapiens
  Native (PRAME_HUMAN)
CELGRPSMVWLSANPCPHCGD

SEQ ID NO: 342903 - protein, 22 aa, Homo sapiens
  Native (PRAME_HUMAN)
CELGRPSMVWLSANPCPHCGDR

SEQ ID NO: 342904 - protein, 23 aa, Homo sapiens
  Native (PRAME_HUMAN)
CELGRPSMVWLSANPCPHCGDRT

SEQ ID NO: 342905 - protein, 24 aa, Homo sapiens
  Native (PRAME_HUMAN)
CELGRPSMVWLSANPCPHCGDRTF

SEQ ID NO: 342906 - protein, 25 aa, Homo sapiens
  Native (PRAME_HUMAN)
CELGRPSMVWLSANPCPHCGDRTFY

SEQ ID NO: 342907 - protein, 20 aa, Homo sapiens
  Native (PRAME_HUMAN)
CGDRTFYDPEPILCPCFMPN

SEQ ID NO: 342908 - protein, 14 aa, Homo sapiens
  Native (PRAME_HUMAN)
CGITDDQLLALLPS

SEQ ID NO: 342909 - protein, 15 aa, Homo sapiens
  Native (PRAME_HUMAN)
CGITDDQLLALLPSL

SEQ ID NO: 342910 - protein, 16 aa, Homo sapiens
  Native (PRAME_HUMAN)
CGITDDQLLALLPSLS

SEQ ID NO: 342911 - protein, 17 aa, Homo sapiens
  Native (PRAME_HUMAN)
CGITDDQLLALLPSLSH

SEQ ID NO: 342912 - protein, 18 aa, Homo sapiens
  Native (PRAME_HUMAN)
CGITDDQLLALLPSLSHC

SEQ ID NO: 342913 - protein, 19 aa, Homo sapiens
  Native (PRAME_HUMAN)
CGITDDQLLALLPSLSHCS

SEQ ID NO: 342914 - protein, 20 aa, Homo sapiens
  Native (PRAME_HUMAN)
CGITDDQLLALLPSLSHCSQ

SEQ ID NO: 342915 - protein, 21 aa, Homo sapiens
  Native (PRAME_HUMAN)
CGITDDQLLALLPSLSHCSQL

SEQ ID NO: 342916 - protein, 22 aa, Homo sapiens
  Native (PRAME_HUMAN)
CGITDDQLLALLPSLSHCSQLT

SEQ ID NO: 342917 - protein, 23 aa, Homo sapiens
  Native (PRAME_HUMAN)
CGITDDQLLALLPSLSHCSQLTT

SEQ ID NO: 342918 - protein, 24 aa, Homo sapiens
  Native (PRAME_HUMAN)
CGITDDQLLALLPSLSHCSQLTTL

SEQ ID NO: 342919 - protein, 25 aa, Homo sapiens
  Native (PRAME_HUMAN)
CGITDDQLLALLPSLSHCSQLTTLS

SEQ ID NO: 342920 - protein, 13 aa, Homo sapiens
  Native (PRAME_HUMAN)
CKKLKIFAMPMQD

SEQ ID NO: 342921 - protein, 14 aa, Homo sapiens
  Native (PRAME_HUMAN)
CKKLKIFAMPMQDI

SEQ ID NO: 342922 - protein, 15 aa, Homo sapiens
  Native (PRAME_HUMAN)
CKKLKIFAMPMQDIK

SEQ ID NO: 342923 - protein, 16 aa, Homo sapiens
  Native (PRAME_HUMAN)
CKKLKIFAMPMQDIKM

SEQ ID NO: 342924 - protein, 17 aa, Homo sapiens
  Native (PRAME_HUMAN)
CKKLKIFAMPMQDIKMI

SEQ ID NO: 342925 - protein, 18 aa, Homo sapiens
  Native (PRAME_HUMAN)
CKKLKIFAMPMQDIKMIL

SEQ ID NO: 342926 - protein, 19 aa, Homo sapiens
  Native (PRAME_HUMAN)
CKKLKIFAMPMQDIKMILK

SEQ ID NO: 342927 - protein, 20 aa, Homo sapiens
  Native (PRAME_HUMAN)
CKKLKIFAMPMQDIKMILKM

SEQ ID NO: 342928 - protein, 21 aa, Homo sapiens
  Native (PRAME_HUMAN)
CKKLKIFAMPMQDIKMILKMV

SEQ ID NO: 342929 - protein, 22 aa, Homo sapiens
  Native (PRAME_HUMAN)
CKKLKIFAMPMQDIKMILKMVQ

SEQ ID NO: 342930 - protein, 23 aa, Homo sapiens
  Native (PRAME_HUMAN)
CKKLKIFAMPMQDIKMILKMVQL

SEQ ID NO: 342931 - protein, 24 aa, Homo sapiens
  Native (PRAME_HUMAN)
CKKLKIFAMPMQDIKMILKMVQLD

SEQ ID NO: 342932 - protein, 25 aa, Homo sapiens
  Native (PRAME_HUMAN)
CKKLKIFAMPMQDIKMILKMVQLDS

SEQ ID NO: 342933 - protein, 13 aa, Homo sapiens
  Native (PRAME_HUMAN)
CLPLGVLMKGQHL

SEQ ID NO: 342934 - protein, 14 aa, Homo sapiens
  Native (PRAME_HUMAN)
CLPLGVLMKGQHLH

SEQ ID NO: 342935 - protein, 15 aa, Homo sapiens
  Native (PRAME_HUMAN)
CLPLGVLMKGQHLHL

SEQ ID NO: 342936 - protein, 16 aa, Homo sapiens
  Native (PRAME_HUMAN)
CLPLGVLMKGQHLHLE

SEQ ID NO: 342937 - protein, 17 aa, Homo sapiens
  Native (PRAME_HUMAN)
CLPLGVLMKGQHLHLET

SEQ ID NO: 342938 - protein, 18 aa, Homo sapiens
  Native (PRAME_HUMAN)
CLPLGVLMKGQHLHLETF

SEQ ID NO: 342939 - protein, 19 aa, Homo sapiens
  Native (PRAME_HUMAN)
CLPLGVLMKGQHLHLETFK

SEQ ID NO: 342940 - protein, 20 aa, Homo sapiens
  Native (PRAME_HUMAN)
CLPLGVLMKGQHLHLETFKA

SEQ ID NO: 342941 - protein, 21 aa, Homo sapiens
  Native (PRAME_HUMAN)
CLPLGVLMKGQHLHLETFKAV

SEQ ID NO: 342942 - protein, 22 aa, Homo sapiens
  Native (PRAME_HUMAN)
CLPLGVLMKGQHLHLETFKAVL

SEQ ID NO: 342943 - protein, 23 aa, Homo sapiens
  Native (PRAME_HUMAN)
CLPLGVLMKGQHLHLETFKAVLD

SEQ ID NO: 342944 - protein, 24 aa, Homo sapiens
  Native (PRAME_HUMAN)
CLPLGVLMKGQHLHLETFKAVLDG

SEQ ID NO: 342945 - protein, 25 aa, Homo sapiens
  Native (PRAME_HUMAN)
CLPLGVLMKGQHLHLETFKAVLDGL

SEQ ID NO: 342946 - protein, 13 aa, Homo sapiens
  Native (PRAME_HUMAN)
CLQALYVDSLFFL

SEQ ID NO: 342947 - protein, 14 aa, Homo sapiens
  Native (PRAME_HUMAN)
CLQALYVDSLFFLR

SEQ ID NO: 342948 - protein, 15 aa, Homo sapiens
  Native (PRAME_HUMAN)
CLQALYVDSLFFLRG

SEQ ID NO: 342949 - protein, 16 aa, Homo sapiens
  Native (PRAME_HUMAN)
CLQALYVDSLFFLRGR

SEQ ID NO: 342950 - protein, 17 aa, Homo sapiens
  Native (PRAME_HUMAN)
CLQALYVDSLFFLRGRL

SEQ ID NO: 342951 - protein, 18 aa, Homo sapiens
  Native (PRAME_HUMAN)
CLQALYVDSLFFLRGRLD

SEQ ID NO: 342952 - protein, 19 aa, Homo sapiens
  Native (PRAME_HUMAN)
CLQALYVDSLFFLRGRLDQ

SEQ ID NO: 342953 - protein, 20 aa, Homo sapiens
  Native (PRAME_HUMAN)
CLQALYVDSLFFLRGRLDQL

SEQ ID NO: 342954 - protein, 21 aa, Homo sapiens
  Native (PRAME_HUMAN)
CLQALYVDSLFFLRGRLDQLL

SEQ ID NO: 342955 - protein, 22 aa, Homo sapiens
  Native (PRAME_HUMAN)
CLQALYVDSLFFLRGRLDQLLR

SEQ ID NO: 342956 - protein, 23 aa, Homo sapiens
  Native (PRAME_HUMAN)
CLQALYVDSLFFLRGRLDQLLRH

SEQ ID NO: 342957 - protein, 24 aa, Homo sapiens
  Native (PRAME_HUMAN)
CLQALYVDSLFFLRGRLDQLLRHV

SEQ ID NO: 342958 - protein, 25 aa, Homo sapiens
  Native (PRAME_HUMAN)
CLQALYVDSLFFLRGRLDQLLRHVM

SEQ ID NO: 342959 - protein, 23 aa, Homo sapiens
  Native (PRAME_HUMAN)
CPHCGDRTFYDPEPILCPCFMPN

SEQ ID NO: 342960 - protein, 17 aa, Homo sapiens
  Native (PRAME_HUMAN)
CRLSEGDVMHLSQSPSV

SEQ ID NO: 342961 - protein, 19 aa, Homo sapiens
  Native (PRAME_HUMAN)
CRLSEGDVMHLSQSPSVSQ

SEQ ID NO: 342962 - protein, 20 aa, Homo sapiens
  Native (PRAME_HUMAN)
CRLSEGDVMHLSQSPSVSQL

SEQ ID NO: 342963 - protein, 21 aa, Homo sapiens
  Native (PRAME_HUMAN)
CRLSEGDVMHLSQSPSVSQLS

SEQ ID NO: 342964 - protein, 22 aa, Homo sapiens
  Native (PRAME_HUMAN)
CRLSEGDVMHLSQSPSVSQLSV

SEQ ID NO: 342965 - protein, 23 aa, Homo sapiens
  Native (PRAME_HUMAN)
CRLSEGDVMHLSQSPSVSQLSVL

SEQ ID NO: 342966 - protein, 24 aa, Homo sapiens
  Native (PRAME_HUMAN)
CRLSEGDVMHLSQSPSVSQLSVLS

SEQ ID NO: 342967 - protein, 25 aa, Homo sapiens
  Native (PRAME_HUMAN)
CRLSEGDVMHLSQSPSVSQLSVLSL

SEQ ID NO: 342968 - protein, 14 aa, Homo sapiens
  Native (PRAME_HUMAN)
CSQLTTLSFYGNSI

SEQ ID NO: 342969 - protein, 15 aa, Homo sapiens
  Native (PRAME_HUMAN)
CSQLTTLSFYGNSIS

SEQ ID NO: 342970 - protein, 16 aa, Homo sapiens
  Native (PRAME_HUMAN)
CSQLTTLSFYGNSISI

SEQ ID NO: 342971 - protein, 17 aa, Homo sapiens
  Native (PRAME_HUMAN)
CSQLTTLSFYGNSISIS

SEQ ID NO: 342972 - protein, 18 aa, Homo sapiens
  Native (PRAME_HUMAN)
CSQLTTLSFYGNSISISA

SEQ ID NO: 342973 - protein, 19 aa, Homo sapiens
  Native (PRAME_HUMAN)
CSQLTTLSFYGNSISISAL

SEQ ID NO: 342974 - protein, 20 aa, Homo sapiens
  Native (PRAME_HUMAN)
CSQLTTLSFYGNSISISALQ

SEQ ID NO: 342975 - protein, 21 aa, Homo sapiens
  Native (PRAME_HUMAN)
CSQLTTLSFYGNSISISALQS

SEQ ID NO: 342976 - protein, 22 aa, Homo sapiens
  Native (PRAME_HUMAN)
CSQLTTLSFYGNSISISALQSL

SEQ ID NO: 342977 - protein, 23 aa, Homo sapiens
  Native (PRAME_HUMAN)
CSQLTTLSFYGNSISISALQSLL

SEQ ID NO: 342978 - protein, 24 aa, Homo sapiens
  Native (PRAME_HUMAN)
CSQLTTLSFYGNSISISALQSLLQ

SEQ ID NO: 342979 - protein, 25 aa, Homo sapiens
  Native (PRAME_HUMAN)
CSQLTTLSFYGNSISISALQSLLQH

SEQ ID NO: 342980 - protein, 15 aa, Homo sapiens
  Native (PRAME_HUMAN)
CTWKLPTLAKFSPYL

SEQ ID NO: 342981 - protein, 16 aa, Homo sapiens
  Native (PRAME_HUMAN)
CTWKLPTLAKFSPYLG

SEQ ID NO: 342982 - protein, 17 aa, Homo sapiens
  Native (PRAME_HUMAN)
CTWKLPTLAKFSPYLGQ

SEQ ID NO: 342983 - protein, 18 aa, Homo sapiens
  Native (PRAME_HUMAN)
CTWKLPTLAKFSPYLGQM

SEQ ID NO: 342984 - protein, 19 aa, Homo sapiens
  Native (PRAME_HUMAN)
CTWKLPTLAKFSPYLGQMI

SEQ ID NO: 342985 - protein, 20 aa, Homo sapiens
  Native (PRAME_HUMAN)
CTWKLPTLAKFSPYLGQMIN

SEQ ID NO: 342986 - protein, 21 aa, Homo sapiens
  Native (PRAME_HUMAN)
CTWKLPTLAKFSPYLGQMINL

SEQ ID NO: 342987 - protein, 22 aa, Homo sapiens
  Native (PRAME_HUMAN)
CTWKLPTLAKFSPYLGQMINLR

SEQ ID NO: 342988 - protein, 23 aa, Homo sapiens
  Native (PRAME_HUMAN)
CTWKLPTLAKFSPYLGQMINLRR

SEQ ID NO: 342989 - protein, 24 aa, Homo sapiens
  Native (PRAME_HUMAN)
CTWKLPTLAKFSPYLGQMINLRRL

SEQ ID NO: 342990 - protein, 25 aa, Homo sapiens
  Native (PRAME_HUMAN)
CTWKLPTLAKFSPYLGQMINLRRLL

SEQ ID NO: 342991 - protein, 13 aa, Homo sapiens
  Native (PRAME_HUMAN)
DDQLLALLPSLSH

SEQ ID NO: 342992 - protein, 14 aa, Homo sapiens
  Native (PRAME_HUMAN)
DDQLLALLPSLSHC

SEQ ID NO: 342993 - protein, 15 aa, Homo sapiens
  Native (PRAME_HUMAN)
DDQLLALLPSLSHCS

SEQ ID NO: 342994 - protein, 16 aa, Homo sapiens
  Native (PRAME_HUMAN)
DDQLLALLPSLSHCSQ

SEQ ID NO: 342995 - protein, 17 aa, Homo sapiens
  Native (PRAME_HUMAN)
DDQLLALLPSLSHCSQL

SEQ ID NO: 342996 - protein, 18 aa, Homo sapiens
  Native (PRAME_HUMAN)
DDQLLALLPSLSHCSQLT

SEQ ID NO: 342997 - protein, 19 aa, Homo sapiens
  Native (PRAME_HUMAN)
DDQLLALLPSLSHCSQLTT

SEQ ID NO: 342998 - protein, 20 aa, Homo sapiens
  Native (PRAME_HUMAN)
DDQLLALLPSLSHCSQLTTL

SEQ ID NO: 342999 - protein, 21 aa, Homo sapiens
  Native (PRAME_HUMAN)
DDQLLALLPSLSHCSQLTTLS

SEQ ID NO: 343000 - protein, 22 aa, Homo sapiens
  Native (PRAME_HUMAN)
DDQLLALLPSLSHCSQLTTLSF

SEQ ID NO: 343001 - protein, 23 aa, Homo sapiens
  Native (PRAME_HUMAN)
DDQLLALLPSLSHCSQLTTLSFY

SEQ ID NO: 343002 - protein, 24 aa, Homo sapiens
  Native (PRAME_HUMAN)
DDQLLALLPSLSHCSQLTTLSFYG

SEQ ID NO: 343003 - protein, 25 aa, Homo sapiens
  Native (PRAME_HUMAN)
DDQLLALLPSLSHCSQLTTLSFYGN

SEQ ID NO: 343004 - protein, 13 aa, Homo sapiens
  Native (PRAME_HUMAN)
DEALAIAALELLP

SEQ ID NO: 343005 - protein, 14 aa, Homo sapiens
  Native (PRAME_HUMAN)
DEALAIAALELLPR

SEQ ID NO: 343006 - protein, 15 aa, Homo sapiens
  Native (PRAME_HUMAN)
DEALAIAALELLPRE

SEQ ID NO: 343007 - protein, 16 aa, Homo sapiens
  Native (PRAME_HUMAN)
DEALAIAALELLPREL

SEQ ID NO: 343008 - protein, 17 aa, Homo sapiens
  Native (PRAME_HUMAN)
DEALAIAALELLPRELF

SEQ ID NO: 343009 - protein, 18 aa, Homo sapiens
  Native (PRAME_HUMAN)
DEALAIAALELLPRELFP

SEQ ID NO: 343010 - protein, 19 aa, Homo sapiens
  Native (PRAME_HUMAN)
DEALAIAALELLPRELFPP

SEQ ID NO: 343011 - protein, 20 aa, Homo sapiens
  Native (PRAME_HUMAN)
DEALAIAALELLPRELFPPL

SEQ ID NO: 343012 - protein, 21 aa, Homo sapiens
  Native (PRAME_HUMAN)
DEALAIAALELLPRELFPPLF

SEQ ID NO: 343013 - protein, 22 aa, Homo sapiens
  Native (PRAME_HUMAN)
DEALAIAALELLPRELFPPLFM

SEQ ID NO: 343014 - protein, 24 aa, Homo sapiens
  Native (PRAME_HUMAN)
DEALAIAALELLPRELFPPLFMAA

SEQ ID NO: 343015 - protein, 25 aa, Homo sapiens
  Native (PRAME_HUMAN)
DEALAIAALELLPRELFPPLFMAAF

SEQ ID NO: 343016 - protein, 14 aa, Homo sapiens
  Native (PRAME_HUMAN)
DECGITDDQLLALL

SEQ ID NO: 343017 - protein, 15 aa, Homo sapiens
  Native (PRAME_HUMAN)
DECGITDDQLLALLP

SEQ ID NO: 343018 - protein, 16 aa, Homo sapiens
  Native (PRAME_HUMAN)
DECGITDDQLLALLPS

SEQ ID NO: 343019 - protein, 17 aa, Homo sapiens
  Native (PRAME_HUMAN)
DECGITDDQLLALLPSL

SEQ ID NO: 343020 - protein, 18 aa, Homo sapiens
  Native (PRAME_HUMAN)
DECGITDDQLLALLPSLS

SEQ ID NO: 343021 - protein, 19 aa, Homo sapiens
  Native (PRAME_HUMAN)
DECGITDDQLLALLPSLSH

SEQ ID NO: 343022 - protein, 20 aa, Homo sapiens
  Native (PRAME_HUMAN)
DECGITDDQLLALLPSLSHC

SEQ ID NO: 343023 - protein, 21 aa, Homo sapiens
  Native (PRAME_HUMAN)
DECGITDDQLLALLPSLSHCS

SEQ ID NO: 343024 - protein, 22 aa, Homo sapiens
  Native (PRAME_HUMAN)
DECGITDDQLLALLPSLSHCSQ

SEQ ID NO: 343025 - protein, 23 aa, Homo sapiens
  Native (PRAME_HUMAN)
DECGITDDQLLALLPSLSHCSQL

SEQ ID NO: 343026 - protein, 24 aa, Homo sapiens
  Native (PRAME_HUMAN)
DECGITDDQLLALLPSLSHCSQLT

SEQ ID NO: 343027 - protein, 25 aa, Homo sapiens
  Native (PRAME_HUMAN)
DECGITDDQLLALLPSLSHCSQLTT

SEQ ID NO: 343028 - protein, 13 aa, Homo sapiens
  Native (PRAME_HUMAN)
DELFSYLIEKVKR

SEQ ID NO: 343029 - protein, 14 aa, Homo sapiens
  Native (PRAME_HUMAN)
DELFSYLIEKVKRK

SEQ ID NO: 343030 - protein, 15 aa, Homo sapiens
  Native (PRAME_HUMAN)
DELFSYLIEKVKRKK

SEQ ID NO: 343031 - protein, 16 aa, Homo sapiens
  Native (PRAME_HUMAN)
DELFSYLIEKVKRKKN

SEQ ID NO: 343032 - protein, 17 aa, Homo sapiens
  Native (PRAME_HUMAN)
DELFSYLIEKVKRKKNV

SEQ ID NO: 343033 - protein, 18 aa, Homo sapiens
  Native (PRAME_HUMAN)
DELFSYLIEKVKRKKNVL

SEQ ID NO: 343034 - protein, 19 aa, Homo sapiens
  Native (PRAME_HUMAN)
DELFSYLIEKVKRKKNVLR

SEQ ID NO: 343035 - protein, 20 aa, Homo sapiens
  Native (PRAME_HUMAN)
DELFSYLIEKVKRKKNVLRL

SEQ ID NO: 343036 - protein, 21 aa, Homo sapiens
  Native (PRAME_HUMAN)
DELFSYLIEKVKRKKNVLRLC

SEQ ID NO: 343037 - protein, 22 aa, Homo sapiens
  Native (PRAME_HUMAN)
DELFSYLIEKVKRKKNVLRLCC

SEQ ID NO: 343038 - protein, 23 aa, Homo sapiens
  Native (PRAME_HUMAN)
DELFSYLIEKVKRKKNVLRLCCK

SEQ ID NO: 343039 - protein, 24 aa, Homo sapiens
  Native (PRAME_HUMAN)
DELFSYLIEKVKRKKNVLRLCCKK

SEQ ID NO: 343040 - protein, 25 aa, Homo sapiens
  Native (PRAME_HUMAN)
DELFSYLIEKVKRKKNVLRLCCKKL

SEQ ID NO: 343041 - protein, 13 aa, Homo sapiens
  Native (PRAME_HUMAN)
DFWTVWSGNRASL

SEQ ID NO: 343042 - protein, 14 aa, Homo sapiens
  Native (PRAME_HUMAN)
DFWTVWSGNRASLY

SEQ ID NO: 343043 - protein, 15 aa, Homo sapiens
  Native (PRAME_HUMAN)
DFWTVWSGNRASLYS

SEQ ID NO: 343044 - protein, 16 aa, Homo sapiens
  Native (PRAME_HUMAN)
DFWTVWSGNRASLYSF

SEQ ID NO: 343045 - protein, 17 aa, Homo sapiens
  Native (PRAME_HUMAN)
DFWTVWSGNRASLYSFP

SEQ ID NO: 343046 - protein, 18 aa, Homo sapiens
  Native (PRAME_HUMAN)
DFWTVWSGNRASLYSFPE

SEQ ID NO: 343047 - protein, 19 aa, Homo sapiens
  Native (PRAME_HUMAN)
DFWTVWSGNRASLYSFPEP

SEQ ID NO: 343048 - protein, 20 aa, Homo sapiens
  Native (PRAME_HUMAN)
DFWTVWSGNRASLYSFPEPE

SEQ ID NO: 343049 - protein, 21 aa, Homo sapiens
  Native (PRAME_HUMAN)
DFWTVWSGNRASLYSFPEPEA

SEQ ID NO: 343050 - protein, 22 aa, Homo sapiens
  Native (PRAME_HUMAN)
DFWTVWSGNRASLYSFPEPEAA

SEQ ID NO: 343051 - protein, 23 aa, Homo sapiens
  Native (PRAME_HUMAN)
DFWTVWSGNRASLYSFPEPEAAQ

SEQ ID NO: 343052 - protein, 24 aa, Homo sapiens
  Native (PRAME_HUMAN)
DFWTVWSGNRASLYSFPEPEAAQP

SEQ ID NO: 343053 - protein, 25 aa, Homo sapiens
  Native (PRAME_HUMAN)
DFWTVWSGNRASLYSFPEPEAAQPM

SEQ ID NO: 343054 - protein, 13 aa, Homo sapiens
  Native (PRAME_HUMAN)
DGLDVLLAQEVRP

SEQ ID NO: 343055 - protein, 14 aa, Homo sapiens
  Native (PRAME_HUMAN)
DGLDVLLAQEVRPR

SEQ ID NO: 343056 - protein, 15 aa, Homo sapiens
  Native (PRAME_HUMAN)
DGLDVLLAQEVRPRR

SEQ ID NO: 343057 - protein, 16 aa, Homo sapiens
  Native (PRAME_HUMAN)
DGLDVLLAQEVRPRRW

SEQ ID NO: 343058 - protein, 17 aa, Homo sapiens
  Native (PRAME_HUMAN)
DGLDVLLAQEVRPRRWK

SEQ ID NO: 343059 - protein, 18 aa, Homo sapiens
  Native (PRAME_HUMAN)
DGLDVLLAQEVRPRRWKL

SEQ ID NO: 343060 - protein, 19 aa, Homo sapiens
  Native (PRAME_HUMAN)
DGLDVLLAQEVRPRRWKLQ

SEQ ID NO: 343061 - protein, 20 aa, Homo sapiens
  Native (PRAME_HUMAN)
DGLDVLLAQEVRPRRWKLQV

SEQ ID NO: 343062 - protein, 21 aa, Homo sapiens
  Native (PRAME_HUMAN)
DGLDVLLAQEVRPRRWKLQVL

SEQ ID NO: 343063 - protein, 22 aa, Homo sapiens
  Native (PRAME_HUMAN)
DGLDVLLAQEVRPRRWKLQVLD

SEQ ID NO: 343064 - protein, 23 aa, Homo sapiens
  Native (PRAME_HUMAN)
DGLDVLLAQEVRPRRWKLQVLDL

SEQ ID NO: 343065 - protein, 24 aa, Homo sapiens
  Native (PRAME_HUMAN)
DGLDVLLAQEVRPRRWKLQVLDLR

SEQ ID NO: 343066 - protein, 25 aa, Homo sapiens
  Native (PRAME_HUMAN)
DGLDVLLAQEVRPRRWKLQVLDLRK

SEQ ID NO: 343067 - protein, 13 aa, Homo sapiens
  Native (PRAME_HUMAN)
DGLSTEAEQPFIP

SEQ ID NO: 343068 - protein, 14 aa, Homo sapiens
  Native (PRAME_HUMAN)
DGLSTEAEQPFIPV

SEQ ID NO: 343069 - protein, 15 aa, Homo sapiens
  Native (PRAME_HUMAN)
DGLSTEAEQPFIPVE

SEQ ID NO: 343070 - protein, 16 aa, Homo sapiens
  Native (PRAME_HUMAN)
DGLSTEAEQPFIPVEV

SEQ ID NO: 343071 - protein, 17 aa, Homo sapiens
  Native (PRAME_HUMAN)
DGLSTEAEQPFIPVEVL

SEQ ID NO: 343072 - protein, 18 aa, Homo sapiens
  Native (PRAME_HUMAN)
DGLSTEAEQPFIPVEVLV

SEQ ID NO: 343073 - protein, 19 aa, Homo sapiens
  Native (PRAME_HUMAN)
DGLSTEAEQPFIPVEVLVD

SEQ ID NO: 343074 - protein, 20 aa, Homo sapiens
  Native (PRAME_HUMAN)
DGLSTEAEQPFIPVEVLVDL

SEQ ID NO: 343075 - protein, 21 aa, Homo sapiens
  Native (PRAME_HUMAN)
DGLSTEAEQPFIPVEVLVDLF

SEQ ID NO: 343076 - protein, 22 aa, Homo sapiens
  Native (PRAME_HUMAN)
DGLSTEAEQPFIPVEVLVDLFL

SEQ ID NO: 343077 - protein, 23 aa, Homo sapiens
  Native (PRAME_HUMAN)
DGLSTEAEQPFIPVEVLVDLFLK

SEQ ID NO: 343078 - protein, 24 aa, Homo sapiens
  Native (PRAME_HUMAN)
DGLSTEAEQPFIPVEVLVDLFLKE

SEQ ID NO: 343079 - protein, 25 aa, Homo sapiens
  Native (PRAME_HUMAN)
DGLSTEAEQPFIPVEVLVDLFLKEG

SEQ ID NO: 343080 - protein, 14 aa, Homo sapiens
  Native (PRAME_HUMAN)
DGRHSQTLKAMVQA

SEQ ID NO: 343081 - protein, 15 aa, Homo sapiens
  Native (PRAME_HUMAN)
DGRHSQTLKAMVQAW

SEQ ID NO: 343082 - protein, 16 aa, Homo sapiens
  Native (PRAME_HUMAN)
DGRHSQTLKAMVQAWP

SEQ ID NO: 343083 - protein, 17 aa, Homo sapiens
  Native (PRAME_HUMAN)
DGRHSQTLKAMVQAWPF

SEQ ID NO: 343084 - protein, 18 aa, Homo sapiens
  Native (PRAME_HUMAN)
DGRHSQTLKAMVQAWPFT

SEQ ID NO: 343085 - protein, 19 aa, Homo sapiens
  Native (PRAME_HUMAN)
DGRHSQTLKAMVQAWPFTC

SEQ ID NO: 343086 - protein, 20 aa, Homo sapiens
  Native (PRAME_HUMAN)
DGRHSQTLKAMVQAWPFTCL

SEQ ID NO: 343087 - protein, 21 aa, Homo sapiens
  Native (PRAME_HUMAN)
DGRHSQTLKAMVQAWPFTCLP

SEQ ID NO: 343088 - protein, 22 aa, Homo sapiens
  Native (PRAME_HUMAN)
DGRHSQTLKAMVQAWPFTCLPL

SEQ ID NO: 343089 - protein, 23 aa, Homo sapiens
  Native (PRAME_HUMAN)
DGRHSQTLKAMVQAWPFTCLPLG

SEQ ID NO: 343090 - protein, 24 aa, Homo sapiens
  Native (PRAME_HUMAN)
DGRHSQTLKAMVQAWPFTCLPLGV

SEQ ID NO: 343091 - protein, 25 aa, Homo sapiens
  Native (PRAME_HUMAN)
DGRHSQTLKAMVQAWPFTCLPLGVL

SEQ ID NO: 343092 - protein, 14 aa, Homo sapiens
  Native (PRAME_HUMAN)
DIHGTLHLERLAYL

SEQ ID NO: 343093 - protein, 15 aa, Homo sapiens
  Native (PRAME_HUMAN)
DIHGTLHLERLAYLH

SEQ ID NO: 343094 - protein, 16 aa, Homo sapiens
  Native (PRAME_HUMAN)
DIHGTLHLERLAYLHA

SEQ ID NO: 343095 - protein, 17 aa, Homo sapiens
  Native (PRAME_HUMAN)
DIHGTLHLERLAYLHAR

SEQ ID NO: 343096 - protein, 18 aa, Homo sapiens
  Native (PRAME_HUMAN)
DIHGTLHLERLAYLHARL

SEQ ID NO: 343097 - protein, 19 aa, Homo sapiens
  Native (PRAME_HUMAN)
DIHGTLHLERLAYLHARLR

SEQ ID NO: 343098 - protein, 20 aa, Homo sapiens
  Native (PRAME_HUMAN)
DIHGTLHLERLAYLHARLRE

SEQ ID NO: 343099 - protein, 21 aa, Homo sapiens
  Native (PRAME_HUMAN)
DIHGTLHLERLAYLHARLREL

SEQ ID NO: 343100 - protein, 22 aa, Homo sapiens
  Native (PRAME_HUMAN)
DIHGTLHLERLAYLHARLRELL

SEQ ID NO: 343101 - protein, 23 aa, Homo sapiens
  Native (PRAME_HUMAN)
DIHGTLHLERLAYLHARLRELLC

SEQ ID NO: 343102 - protein, 24 aa, Homo sapiens
  Native (PRAME_HUMAN)
DIHGTLHLERLAYLHARLRELLCE

SEQ ID NO: 343103 - protein, 25 aa, Homo sapiens
  Native (PRAME_HUMAN)
DIHGTLHLERLAYLHARLRELLCEL

SEQ ID NO: 343104 - protein, 13 aa, Homo sapiens
  Native (PRAME_HUMAN)
DIKMILKMVQLDS

SEQ ID NO: 343105 - protein, 14 aa, Homo sapiens
  Native (PRAME_HUMAN)
DIKMILKMVQLDSI

SEQ ID NO: 343106 - protein, 15 aa, Homo sapiens
  Native (PRAME_HUMAN)
DIKMILKMVQLDSIE

SEQ ID NO: 343107 - protein, 16 aa, Homo sapiens
  Native (PRAME_HUMAN)
DIKMILKMVQLDSIED

SEQ ID NO: 343108 - protein, 17 aa, Homo sapiens
  Native (PRAME_HUMAN)
DIKMILKMVQLDSIEDL

SEQ ID NO: 343109 - protein, 18 aa, Homo sapiens
  Native (PRAME_HUMAN)
DIKMILKMVQLDSIEDLE

SEQ ID NO: 343110 - protein, 19 aa, Homo sapiens
  Native (PRAME_HUMAN)
DIKMILKMVQLDSIEDLEV

SEQ ID NO: 343111 - protein, 20 aa, Homo sapiens
  Native (PRAME_HUMAN)
DIKMILKMVQLDSIEDLEVT

SEQ ID NO: 343112 - protein, 21 aa, Homo sapiens
  Native (PRAME_HUMAN)
DIKMILKMVQLDSIEDLEVTC

SEQ ID NO: 343113 - protein, 22 aa, Homo sapiens
  Native (PRAME_HUMAN)
DIKMILKMVQLDSIEDLEVTCT

SEQ ID NO: 343114 - protein, 23 aa, Homo sapiens
  Native (PRAME_HUMAN)
DIKMILKMVQLDSIEDLEVTCTW

SEQ ID NO: 343115 - protein, 24 aa, Homo sapiens
  Native (PRAME_HUMAN)
DIKMILKMVQLDSIEDLEVTCTWK

SEQ ID NO: 343116 - protein, 25 aa, Homo sapiens
  Native (PRAME_HUMAN)
DIKMILKMVQLDSIEDLEVTCTWKL

SEQ ID NO: 343117 - protein, 14 aa, Homo sapiens
  Native (PRAME_HUMAN)
DLEVTCTWKLPTLA

SEQ ID NO: 343118 - protein, 15 aa, Homo sapiens
  Native (PRAME_HUMAN)
DLEVTCTWKLPTLAK

SEQ ID NO: 343119 - protein, 16 aa, Homo sapiens
  Native (PRAME_HUMAN)
DLEVTCTWKLPTLAKF

SEQ ID NO: 343120 - protein, 17 aa, Homo sapiens
  Native (PRAME_HUMAN)
DLEVTCTWKLPTLAKFS

SEQ ID NO: 343121 - protein, 18 aa, Homo sapiens
  Native (PRAME_HUMAN)
DLEVTCTWKLPTLAKFSP

SEQ ID NO: 343122 - protein, 19 aa, Homo sapiens
  Native (PRAME_HUMAN)
DLEVTCTWKLPTLAKFSPY

SEQ ID NO: 343123 - protein, 20 aa, Homo sapiens
  Native (PRAME_HUMAN)
DLEVTCTWKLPTLAKFSPYL

SEQ ID NO: 343124 - protein, 21 aa, Homo sapiens
  Native (PRAME_HUMAN)
DLEVTCTWKLPTLAKFSPYLG

SEQ ID NO: 343125 - protein, 22 aa, Homo sapiens
  Native (PRAME_HUMAN)
DLEVTCTWKLPTLAKFSPYLGQ

SEQ ID NO: 343126 - protein, 23 aa, Homo sapiens
  Native (PRAME_HUMAN)
DLEVTCTWKLPTLAKFSPYLGQM

SEQ ID NO: 343127 - protein, 24 aa, Homo sapiens
  Native (PRAME_HUMAN)
DLEVTCTWKLPTLAKFSPYLGQMI

SEQ ID NO: 343128 - protein, 25 aa, Homo sapiens
  Native (PRAME_HUMAN)
DLEVTCTWKLPTLAKFSPYLGQMIN

SEQ ID NO: 343129 - protein, 15 aa, Homo sapiens
  Native (PRAME_HUMAN)
DLFLKEGACDELFSY

SEQ ID NO: 343130 - protein, 16 aa, Homo sapiens
  Native (PRAME_HUMAN)
DLFLKEGACDELFSYL

SEQ ID NO: 343131 - protein, 17 aa, Homo sapiens
  Native (PRAME_HUMAN)
DLFLKEGACDELFSYLI

SEQ ID NO: 343132 - protein, 19 aa, Homo sapiens
  Native (PRAME_HUMAN)
DLFLKEGACDELFSYLIEK

SEQ ID NO: 343133 - protein, 20 aa, Homo sapiens
  Native (PRAME_HUMAN)
DLFLKEGACDELFSYLIEKV

SEQ ID NO: 343134 - protein, 21 aa, Homo sapiens
  Native (PRAME_HUMAN)
DLFLKEGACDELFSYLIEKVK

SEQ ID NO: 343135 - protein, 22 aa, Homo sapiens
  Native (PRAME_HUMAN)
DLFLKEGACDELFSYLIEKVKR

SEQ ID NO: 343136 - protein, 23 aa, Homo sapiens
  Native (PRAME_HUMAN)
DLFLKEGACDELFSYLIEKVKRK

SEQ ID NO: 343137 - protein, 24 aa, Homo sapiens
  Native (PRAME_HUMAN)
DLFLKEGACDELFSYLIEKVKRKK

SEQ ID NO: 343138 - protein, 25 aa, Homo sapiens
  Native (PRAME_HUMAN)
DLFLKEGACDELFSYLIEKVKRKKN

SEQ ID NO: 343139 - protein, 14 aa, Homo sapiens
  Native (PRAME_HUMAN)
DLRKNSHQDFWTVW

SEQ ID NO: 343140 - protein, 15 aa, Homo sapiens
  Native (PRAME_HUMAN)
DLRKNSHQDFWTVWS

SEQ ID NO: 343141 - protein, 16 aa, Homo sapiens
  Native (PRAME_HUMAN)
DLRKNSHQDFWTVWSG

SEQ ID NO: 343142 - protein, 19 aa, Homo sapiens
  Native (PRAME_HUMAN)
DLRKNSHQDFWTVWSGNRA

SEQ ID NO: 343143 - protein, 20 aa, Homo sapiens
  Native (PRAME_HUMAN)
DLRKNSHQDFWTVWSGNRAS

SEQ ID NO: 343144 - protein, 21 aa, Homo sapiens
  Native (PRAME_HUMAN)
DLRKNSHQDFWTVWSGNRASL

SEQ ID NO: 343145 - protein, 22 aa, Homo sapiens
  Native (PRAME_HUMAN)
DLRKNSHQDFWTVWSGNRASLY

SEQ ID NO: 343146 - protein, 23 aa, Homo sapiens
  Native (PRAME_HUMAN)
DLRKNSHQDFWTVWSGNRASLYS

SEQ ID NO: 343147 - protein, 24 aa, Homo sapiens
  Native (PRAME_HUMAN)
DLRKNSHQDFWTVWSGNRASLYSF

SEQ ID NO: 343148 - protein, 25 aa, Homo sapiens
  Native (PRAME_HUMAN)
DLRKNSHQDFWTVWSGNRASLYSFP

SEQ ID NO: 343149 - protein, 17 aa, Homo sapiens
  Native (PRAME_HUMAN)
DLVFDECGITDDQLLAL

SEQ ID NO: 343150 - protein, 19 aa, Homo sapiens
  Native (PRAME_HUMAN)
DLVFDECGITDDQLLALLP

SEQ ID NO: 343151 - protein, 20 aa, Homo sapiens
  Native (PRAME_HUMAN)
DLVFDECGITDDQLLALLPS

SEQ ID NO: 343152 - protein, 21 aa, Homo sapiens
  Native (PRAME_HUMAN)
DLVFDECGITDDQLLALLPSL

SEQ ID NO: 343153 - protein, 22 aa, Homo sapiens
  Native (PRAME_HUMAN)
DLVFDECGITDDQLLALLPSLS

SEQ ID NO: 343154 - protein, 23 aa, Homo sapiens
  Native (PRAME_HUMAN)
DLVFDECGITDDQLLALLPSLSH

SEQ ID NO: 343155 - protein, 24 aa, Homo sapiens
  Native (PRAME_HUMAN)
DLVFDECGITDDQLLALLPSLSHC

SEQ ID NO: 343156 - protein, 25 aa, Homo sapiens
  Native (PRAME_HUMAN)
DLVFDECGITDDQLLALLPSLSHCS

SEQ ID NO: 343157 - protein, 13 aa, Homo sapiens
  Native (PRAME_HUMAN)
DQLLALLPSLSHC

SEQ ID NO: 343158 - protein, 14 aa, Homo sapiens
  Native (PRAME_HUMAN)
DQLLALLPSLSHCS

SEQ ID NO: 343159 - protein, 15 aa, Homo sapiens
  Native (PRAME_HUMAN)
DQLLALLPSLSHCSQ

SEQ ID NO: 343160 - protein, 16 aa, Homo sapiens
  Native (PRAME_HUMAN)
DQLLALLPSLSHCSQL

SEQ ID NO: 343161 - protein, 17 aa, Homo sapiens
  Native (PRAME_HUMAN)
DQLLALLPSLSHCSQLT

SEQ ID NO: 343162 - protein, 18 aa, Homo sapiens
  Native (PRAME_HUMAN)
DQLLALLPSLSHCSQLTT

SEQ ID NO: 343163 - protein, 19 aa, Homo sapiens
  Native (PRAME_HUMAN)
DQLLALLPSLSHCSQLTTL

SEQ ID NO: 343164 - protein, 20 aa, Homo sapiens
  Native (PRAME_HUMAN)
DQLLALLPSLSHCSQLTTLS

SEQ ID NO: 343165 - protein, 21 aa, Homo sapiens
  Native (PRAME_HUMAN)
DQLLALLPSLSHCSQLTTLSF

SEQ ID NO: 343166 - protein, 22 aa, Homo sapiens
  Native (PRAME_HUMAN)
DQLLALLPSLSHCSQLTTLSFY

SEQ ID NO: 343167 - protein, 23 aa, Homo sapiens
  Native (PRAME_HUMAN)
DQLLALLPSLSHCSQLTTLSFYG

SEQ ID NO: 343168 - protein, 24 aa, Homo sapiens
  Native (PRAME_HUMAN)
DQLLALLPSLSHCSQLTTLSFYGN

SEQ ID NO: 343169 - protein, 25 aa, Homo sapiens
  Native (PRAME_HUMAN)
DQLLALLPSLSHCSQLTTLSFYGNS

SEQ ID NO: 343170 - protein, 13 aa, Homo sapiens
  Native (PRAME_HUMAN)
DQLLRHVMNPLET

SEQ ID NO: 343171 - protein, 14 aa, Homo sapiens
  Native (PRAME_HUMAN)
DQLLRHVMNPLETL

SEQ ID NO: 343172 - protein, 16 aa, Homo sapiens
  Native (PRAME_HUMAN)
DQLLRHVMNPLETLSI

SEQ ID NO: 343173 - protein, 17 aa, Homo sapiens
  Native (PRAME_HUMAN)
DQLLRHVMNPLETLSIT

SEQ ID NO: 343174 - protein, 18 aa, Homo sapiens
  Native (PRAME_HUMAN)
DQLLRHVMNPLETLSITN

SEQ ID NO: 343175 - protein, 19 aa, Homo sapiens
  Native (PRAME_HUMAN)
DQLLRHVMNPLETLSITNC

SEQ ID NO: 343176 - protein, 20 aa, Homo sapiens
  Native (PRAME_HUMAN)
DQLLRHVMNPLETLSITNCR

SEQ ID NO: 343177 - protein, 21 aa, Homo sapiens
  Native (PRAME_HUMAN)
DQLLRHVMNPLETLSITNCRL

SEQ ID NO: 343178 - protein, 22 aa, Homo sapiens
  Native (PRAME_HUMAN)
DQLLRHVMNPLETLSITNCRLS

SEQ ID NO: 343179 - protein, 23 aa, Homo sapiens
  Native (PRAME_HUMAN)
DQLLRHVMNPLETLSITNCRLSE

SEQ ID NO: 343180 - protein, 24 aa, Homo sapiens
  Native (PRAME_HUMAN)
DQLLRHVMNPLETLSITNCRLSEG

SEQ ID NO: 343181 - protein, 25 aa, Homo sapiens
  Native (PRAME_HUMAN)
DQLLRHVMNPLETLSITNCRLSEGD

SEQ ID NO: 343182 - protein, 14 aa, Homo sapiens
  Native (PRAME_HUMAN)
DSIEDLEVTCTWKL

SEQ ID NO: 343183 - protein, 15 aa, Homo sapiens
  Native (PRAME_HUMAN)
DSIEDLEVTCTWKLP

SEQ ID NO: 343184 - protein, 16 aa, Homo sapiens
  Native (PRAME_HUMAN)
DSIEDLEVTCTWKLPT

SEQ ID NO: 343185 - protein, 17 aa, Homo sapiens
  Native (PRAME_HUMAN)
DSIEDLEVTCTWKLPTL

SEQ ID NO: 343186 - protein, 19 aa, Homo sapiens
  Native (PRAME_HUMAN)
DSIEDLEVTCTWKLPTLAK

SEQ ID NO: 343187 - protein, 20 aa, Homo sapiens
  Native (PRAME_HUMAN)
DSIEDLEVTCTWKLPTLAKF

SEQ ID NO: 343188 - protein, 21 aa, Homo sapiens
  Native (PRAME_HUMAN)
DSIEDLEVTCTWKLPTLAKFS

SEQ ID NO: 343189 - protein, 22 aa, Homo sapiens
  Native (PRAME_HUMAN)
DSIEDLEVTCTWKLPTLAKFSP

SEQ ID NO: 343190 - protein, 23 aa, Homo sapiens
  Native (PRAME_HUMAN)
DSIEDLEVTCTWKLPTLAKFSPY

SEQ ID NO: 343191 - protein, 24 aa, Homo sapiens
  Native (PRAME_HUMAN)
DSIEDLEVTCTWKLPTLAKFSPYL

SEQ ID NO: 343192 - protein, 25 aa, Homo sapiens
  Native (PRAME_HUMAN)
DSIEDLEVTCTWKLPTLAKFSPYLG

SEQ ID NO: 343193 - protein, 13 aa, Homo sapiens
  Native (PRAME_HUMAN)
DSLFFLRGRLDQL

SEQ ID NO: 343194 - protein, 14 aa, Homo sapiens
  Native (PRAME_HUMAN)
DSLFFLRGRLDQLL

SEQ ID NO: 343195 - protein, 15 aa, Homo sapiens
  Native (PRAME_HUMAN)
DSLFFLRGRLDQLLR

SEQ ID NO: 343196 - protein, 16 aa, Homo sapiens
  Native (PRAME_HUMAN)
DSLFFLRGRLDQLLRH

SEQ ID NO: 343197 - protein, 17 aa, Homo sapiens
  Native (PRAME_HUMAN)
DSLFFLRGRLDQLLRHV

SEQ ID NO: 343198 - protein, 18 aa, Homo sapiens
  Native (PRAME_HUMAN)
DSLFFLRGRLDQLLRHVM

SEQ ID NO: 343199 - protein, 19 aa, Homo sapiens
  Native (PRAME_HUMAN)
DSLFFLRGRLDQLLRHVMN

SEQ ID NO: 343200 - protein, 20 aa, Homo sapiens
  Native (PRAME_HUMAN)
DSLFFLRGRLDQLLRHVMNP

SEQ ID NO: 343201 - protein, 21 aa, Homo sapiens
  Native (PRAME_HUMAN)
DSLFFLRGRLDQLLRHVMNPL

SEQ ID NO: 343202 - protein, 22 aa, Homo sapiens
  Native (PRAME_HUMAN)
DSLFFLRGRLDQLLRHVMNPLE

SEQ ID NO: 343203 - protein, 23 aa, Homo sapiens
  Native (PRAME_HUMAN)
DSLFFLRGRLDQLLRHVMNPLET

SEQ ID NO: 343204 - protein, 24 aa, Homo sapiens
  Native (PRAME_HUMAN)
DSLFFLRGRLDQLLRHVMNPLETL

SEQ ID NO: 343205 - protein, 25 aa, Homo sapiens
  Native (PRAME_HUMAN)
DSLFFLRGRLDQLLRHVMNPLETLS

SEQ ID NO: 343206 - protein, 14 aa, Homo sapiens
  Native (PRAME_HUMAN)
DVLLAQEVRPRRWK

SEQ ID NO: 343207 - protein, 15 aa, Homo sapiens
  Native (PRAME_HUMAN)
DVLLAQEVRPRRWKL

SEQ ID NO: 343208 - protein, 16 aa, Homo sapiens
  Native (PRAME_HUMAN)
DVLLAQEVRPRRWKLQ

SEQ ID NO: 343209 - protein, 17 aa, Homo sapiens
  Native (PRAME_HUMAN)
DVLLAQEVRPRRWKLQV

SEQ ID NO: 343210 - protein, 18 aa, Homo sapiens
  Native (PRAME_HUMAN)
DVLLAQEVRPRRWKLQVL

SEQ ID NO: 343211 - protein, 19 aa, Homo sapiens
  Native (PRAME_HUMAN)
DVLLAQEVRPRRWKLQVLD

SEQ ID NO: 343212 - protein, 20 aa, Homo sapiens
  Native (PRAME_HUMAN)
DVLLAQEVRPRRWKLQVLDL

SEQ ID NO: 343213 - protein, 21 aa, Homo sapiens
  Native (PRAME_HUMAN)
DVLLAQEVRPRRWKLQVLDLR

SEQ ID NO: 343214 - protein, 22 aa, Homo sapiens
  Native (PRAME_HUMAN)
DVLLAQEVRPRRWKLQVLDLRK

SEQ ID NO: 343215 - protein, 23 aa, Homo sapiens
  Native (PRAME_HUMAN)
DVLLAQEVRPRRWKLQVLDLRKN

SEQ ID NO: 343216 - protein, 24 aa, Homo sapiens
  Native (PRAME_HUMAN)
DVLLAQEVRPRRWKLQVLDLRKNS

SEQ ID NO: 343217 - protein, 25 aa, Homo sapiens
  Native (PRAME_HUMAN)
DVLLAQEVRPRRWKLQVLDLRKNSH

SEQ ID NO: 343218 - protein, 14 aa, Homo sapiens
  Native (PRAME_HUMAN)
DVMHLSQSPSVSQL

SEQ ID NO: 343219 - protein, 15 aa, Homo sapiens
  Native (PRAME_HUMAN)
DVMHLSQSPSVSQLS

SEQ ID NO: 343220 - protein, 16 aa, Homo sapiens
  Native (PRAME_HUMAN)
DVMHLSQSPSVSQLSV

SEQ ID NO: 343221 - protein, 17 aa, Homo sapiens
  Native (PRAME_HUMAN)
DVMHLSQSPSVSQLSVL

SEQ ID NO: 343222 - protein, 18 aa, Homo sapiens
  Native (PRAME_HUMAN)
DVMHLSQSPSVSQLSVLS

SEQ ID NO: 343223 - protein, 19 aa, Homo sapiens
  Native (PRAME_HUMAN)
DVMHLSQSPSVSQLSVLSL

SEQ ID NO: 343224 - protein, 20 aa, Homo sapiens
  Native (PRAME_HUMAN)
DVMHLSQSPSVSQLSVLSLS

SEQ ID NO: 343225 - protein, 21 aa, Homo sapiens
  Native (PRAME_HUMAN)
DVMHLSQSPSVSQLSVLSLSG

SEQ ID NO: 343226 - protein, 22 aa, Homo sapiens
  Native (PRAME_HUMAN)
DVMHLSQSPSVSQLSVLSLSGV

SEQ ID NO: 343227 - protein, 23 aa, Homo sapiens
  Native (PRAME_HUMAN)
DVMHLSQSPSVSQLSVLSLSGVM

SEQ ID NO: 343228 - protein, 24 aa, Homo sapiens
  Native (PRAME_HUMAN)
DVMHLSQSPSVSQLSVLSLSGVML

SEQ ID NO: 343229 - protein, 25 aa, Homo sapiens
  Native (PRAME_HUMAN)
DVMHLSQSPSVSQLSVLSLSGVMLT

SEQ ID NO: 343230 - protein, 15 aa, Homo sapiens
  Native (PRAME_HUMAN)
DVSPEPLQALLERAS

SEQ ID NO: 343231 - protein, 16 aa, Homo sapiens
  Native (PRAME_HUMAN)
DVSPEPLQALLERASA

SEQ ID NO: 343232 - protein, 17 aa, Homo sapiens
  Native (PRAME_HUMAN)
DVSPEPLQALLERASAT

SEQ ID NO: 343233 - protein, 19 aa, Homo sapiens
  Native (PRAME_HUMAN)
DVSPEPLQALLERASATLQ

SEQ ID NO: 343234 - protein, 20 aa, Homo sapiens
  Native (PRAME_HUMAN)
DVSPEPLQALLERASATLQD

SEQ ID NO: 343235 - protein, 21 aa, Homo sapiens
  Native (PRAME_HUMAN)
DVSPEPLQALLERASATLQDL

SEQ ID NO: 343236 - protein, 22 aa, Homo sapiens
  Native (PRAME_HUMAN)
DVSPEPLQALLERASATLQDLV

SEQ ID NO: 343237 - protein, 23 aa, Homo sapiens
  Native (PRAME_HUMAN)
DVSPEPLQALLERASATLQDLVF

SEQ ID NO: 343238 - protein, 24 aa, Homo sapiens
  Native (PRAME_HUMAN)
DVSPEPLQALLERASATLQDLVFD

SEQ ID NO: 343239 - protein, 25 aa, Homo sapiens
  Native (PRAME_HUMAN)
DVSPEPLQALLERASATLQDLVFDE

SEQ ID NO: 343240 - protein, 15 aa, Homo sapiens
  Native (PRAME_HUMAN)
EAAQPMTKKRKVDGL

SEQ ID NO: 343241 - protein, 17 aa, Homo sapiens
  Native (PRAME_HUMAN)
EAAQPMTKKRKVDGLST

SEQ ID NO: 343242 - protein, 23 aa, Homo sapiens
  Native (PRAME_HUMAN)
EAAQPMTKKRKVDGLSTEAEQPF

SEQ ID NO: 343243 - protein, 24 aa, Homo sapiens
  Native (PRAME_HUMAN)
EAAQPMTKKRKVDGLSTEAEQPFI

SEQ ID NO: 343244 - protein, 25 aa, Homo sapiens
  Native (PRAME_HUMAN)
EAAQPMTKKRKVDGLSTEAEQPFIP

SEQ ID NO: 343245 - protein, 14 aa, Homo sapiens
  Native (PRAME_HUMAN)
EAEQPFIPVEVLVD

SEQ ID NO: 343246 - protein, 15 aa, Homo sapiens
  Native (PRAME_HUMAN)
EAEQPFIPVEVLVDL

SEQ ID NO: 343247 - protein, 16 aa, Homo sapiens
  Native (PRAME_HUMAN)
EAEQPFIPVEVLVDLF

SEQ ID NO: 343248 - protein, 17 aa, Homo sapiens
  Native (PRAME_HUMAN)
EAEQPFIPVEVLVDLFL

SEQ ID NO: 343249 - protein, 18 aa, Homo sapiens
  Native (PRAME_HUMAN)
EAEQPFIPVEVLVDLFLK

SEQ ID NO: 343250 - protein, 19 aa, Homo sapiens
  Native (PRAME_HUMAN)
EAEQPFIPVEVLVDLFLKE

SEQ ID NO: 343251 - protein, 20 aa, Homo sapiens
  Native (PRAME_HUMAN)
EAEQPFIPVEVLVDLFLKEG

SEQ ID NO: 343252 - protein, 21 aa, Homo sapiens
  Native (PRAME_HUMAN)
EAEQPFIPVEVLVDLFLKEGA

SEQ ID NO: 343253 - protein, 22 aa, Homo sapiens
  Native (PRAME_HUMAN)
EAEQPFIPVEVLVDLFLKEGAC

SEQ ID NO: 343254 - protein, 23 aa, Homo sapiens
  Native (PRAME_HUMAN)
EAEQPFIPVEVLVDLFLKEGACD

SEQ ID NO: 343255 - protein, 24 aa, Homo sapiens
  Native (PRAME_HUMAN)
EAEQPFIPVEVLVDLFLKEGACDE

SEQ ID NO: 343256 - protein, 25 aa, Homo sapiens
  Native (PRAME_HUMAN)
EAEQPFIPVEVLVDLFLKEGACDEL

SEQ ID NO: 343257 - protein, 13 aa, Homo sapiens
  Native (PRAME_HUMAN)
EALAIAALELLPR

SEQ ID NO: 343258 - protein, 14 aa, Homo sapiens
  Native (PRAME_HUMAN)
EALAIAALELLPRE

SEQ ID NO: 343259 - protein, 15 aa, Homo sapiens
  Native (PRAME_HUMAN)
EALAIAALELLPREL

SEQ ID NO: 343260 - protein, 16 aa, Homo sapiens
  Native (PRAME_HUMAN)
EALAIAALELLPRELF

SEQ ID NO: 343261 - protein, 17 aa, Homo sapiens
  Native (PRAME_HUMAN)
EALAIAALELLPRELFP

SEQ ID NO: 343262 - protein, 18 aa, Homo sapiens
  Native (PRAME_HUMAN)
EALAIAALELLPRELFPP

SEQ ID NO: 343263 - protein, 19 aa, Homo sapiens
  Native (PRAME_HUMAN)
EALAIAALELLPRELFPPL

SEQ ID NO: 343264 - protein, 20 aa, Homo sapiens
  Native (PRAME_HUMAN)
EALAIAALELLPRELFPPLF

SEQ ID NO: 343265 - protein, 21 aa, Homo sapiens
  Native (PRAME_HUMAN)
EALAIAALELLPRELFPPLFM

SEQ ID NO: 343266 - protein, 22 aa, Homo sapiens
  Native (PRAME_HUMAN)
EALAIAALELLPRELFPPLFMA

SEQ ID NO: 343267 - protein, 23 aa, Homo sapiens
  Native (PRAME_HUMAN)
EALAIAALELLPRELFPPLFMAA

SEQ ID NO: 343268 - protein, 24 aa, Homo sapiens
  Native (PRAME_HUMAN)
EALAIAALELLPRELFPPLFMAAF

SEQ ID NO: 343269 - protein, 25 aa, Homo sapiens
  Native (PRAME_HUMAN)
EALAIAALELLPRELFPPLFMAAFD

SEQ ID NO: 343270 - protein, 14 aa, Homo sapiens
  Native (PRAME_HUMAN)
ECGITDDQLLALLP

SEQ ID NO: 343271 - protein, 15 aa, Homo sapiens
  Native (PRAME_HUMAN)
ECGITDDQLLALLPS

SEQ ID NO: 343272 - protein, 16 aa, Homo sapiens
  Native (PRAME_HUMAN)
ECGITDDQLLALLPSL

SEQ ID NO: 343273 - protein, 17 aa, Homo sapiens
  Native (PRAME_HUMAN)
ECGITDDQLLALLPSLS

SEQ ID NO: 343274 - protein, 18 aa, Homo sapiens
  Native (PRAME_HUMAN)
ECGITDDQLLALLPSLSH

SEQ ID NO: 343275 - protein, 19 aa, Homo sapiens
  Native (PRAME_HUMAN)
ECGITDDQLLALLPSLSHC

SEQ ID NO: 343276 - protein, 20 aa, Homo sapiens
  Native (PRAME_HUMAN)
ECGITDDQLLALLPSLSHCS

SEQ ID NO: 343277 - protein, 21 aa, Homo sapiens
  Native (PRAME_HUMAN)
ECGITDDQLLALLPSLSHCSQ

SEQ ID NO: 343278 - protein, 22 aa, Homo sapiens
  Native (PRAME_HUMAN)
ECGITDDQLLALLPSLSHCSQL

SEQ ID NO: 343279 - protein, 23 aa, Homo sapiens
  Native (PRAME_HUMAN)
ECGITDDQLLALLPSLSHCSQLT

SEQ ID NO: 343280 - protein, 24 aa, Homo sapiens
  Native (PRAME_HUMAN)
ECGITDDQLLALLPSLSHCSQLTT

SEQ ID NO: 343281 - protein, 25 aa, Homo sapiens
  Native (PRAME_HUMAN)
ECGITDDQLLALLPSLSHCSQLTTL

SEQ ID NO: 343282 - protein, 14 aa, Homo sapiens
  Native (PRAME_HUMAN)
EDIHGTLHLERLAY

SEQ ID NO: 343283 - protein, 15 aa, Homo sapiens
  Native (PRAME_HUMAN)
EDIHGTLHLERLAYL

SEQ ID NO: 343284 - protein, 16 aa, Homo sapiens
  Native (PRAME_HUMAN)
EDIHGTLHLERLAYLH

SEQ ID NO: 343285 - protein, 17 aa, Homo sapiens
  Native (PRAME_HUMAN)
EDIHGTLHLERLAYLHA

SEQ ID NO: 343286 - protein, 18 aa, Homo sapiens
  Native (PRAME_HUMAN)
EDIHGTLHLERLAYLHAR

SEQ ID NO: 343287 - protein, 19 aa, Homo sapiens
  Native (PRAME_HUMAN)
EDIHGTLHLERLAYLHARL

SEQ ID NO: 343288 - protein, 20 aa, Homo sapiens
  Native (PRAME_HUMAN)
EDIHGTLHLERLAYLHARLR

SEQ ID NO: 343289 - protein, 21 aa, Homo sapiens
  Native (PRAME_HUMAN)
EDIHGTLHLERLAYLHARLRE

SEQ ID NO: 343290 - protein, 22 aa, Homo sapiens
  Native (PRAME_HUMAN)
EDIHGTLHLERLAYLHARLREL

SEQ ID NO: 343291 - protein, 23 aa, Homo sapiens
  Native (PRAME_HUMAN)
EDIHGTLHLERLAYLHARLRELL

SEQ ID NO: 343292 - protein, 24 aa, Homo sapiens
  Native (PRAME_HUMAN)
EDIHGTLHLERLAYLHARLRELLC

SEQ ID NO: 343293 - protein, 25 aa, Homo sapiens
  Native (PRAME_HUMAN)
EDIHGTLHLERLAYLHARLRELLCE

SEQ ID NO: 343294 - protein, 14 aa, Homo sapiens
  Native (PRAME_HUMAN)
EDLEVTCTWKLPTL

SEQ ID NO: 343295 - protein, 15 aa, Homo sapiens
  Native (PRAME_HUMAN)
EDLEVTCTWKLPTLA

SEQ ID NO: 343296 - protein, 16 aa, Homo sapiens
  Native (PRAME_HUMAN)
EDLEVTCTWKLPTLAK

SEQ ID NO: 343297 - protein, 17 aa, Homo sapiens
  Native (PRAME_HUMAN)
EDLEVTCTWKLPTLAKF

SEQ ID NO: 343298 - protein, 18 aa, Homo sapiens
  Native (PRAME_HUMAN)
EDLEVTCTWKLPTLAKFS

SEQ ID NO: 343299 - protein, 19 aa, Homo sapiens
  Native (PRAME_HUMAN)
EDLEVTCTWKLPTLAKFSP

SEQ ID NO: 343300 - protein, 20 aa, Homo sapiens
  Native (PRAME_HUMAN)
EDLEVTCTWKLPTLAKFSPY

SEQ ID NO: 343301 - protein, 21 aa, Homo sapiens
  Native (PRAME_HUMAN)
EDLEVTCTWKLPTLAKFSPYL

SEQ ID NO: 343302 - protein, 22 aa, Homo sapiens
  Native (PRAME_HUMAN)
EDLEVTCTWKLPTLAKFSPYLG

SEQ ID NO: 343303 - protein, 23 aa, Homo sapiens
  Native (PRAME_HUMAN)
EDLEVTCTWKLPTLAKFSPYLGQ

SEQ ID NO: 343304 - protein, 24 aa, Homo sapiens
  Native (PRAME_HUMAN)
EDLEVTCTWKLPTLAKFSPYLGQM

SEQ ID NO: 343305 - protein, 25 aa, Homo sapiens
  Native (PRAME_HUMAN)
EDLEVTCTWKLPTLAKFSPYLGQMI

SEQ ID NO: 343306 - protein, 13 aa, Homo sapiens
  Native (PRAME_HUMAN)
EEQYIAQFTSQFL

SEQ ID NO: 343307 - protein, 14 aa, Homo sapiens
  Native (PRAME_HUMAN)
EEQYIAQFTSQFLS

SEQ ID NO: 343308 - protein, 15 aa, Homo sapiens
  Native (PRAME_HUMAN)
EEQYIAQFTSQFLSL

SEQ ID NO: 343309 - protein, 16 aa, Homo sapiens
  Native (PRAME_HUMAN)
EEQYIAQFTSQFLSLQ

SEQ ID NO: 343310 - protein, 17 aa, Homo sapiens
  Native (PRAME_HUMAN)
EEQYIAQFTSQFLSLQC

SEQ ID NO: 343311 - protein, 18 aa, Homo sapiens
  Native (PRAME_HUMAN)
EEQYIAQFTSQFLSLQCL

SEQ ID NO: 343312 - protein, 19 aa, Homo sapiens
  Native (PRAME_HUMAN)
EEQYIAQFTSQFLSLQCLQ

SEQ ID NO: 343313 - protein, 20 aa, Homo sapiens
  Native (PRAME_HUMAN)
EEQYIAQFTSQFLSLQCLQA

SEQ ID NO: 343314 - protein, 21 aa, Homo sapiens
  Native (PRAME_HUMAN)
EEQYIAQFTSQFLSLQCLQAL

SEQ ID NO: 343315 - protein, 22 aa, Homo sapiens
  Native (PRAME_HUMAN)
EEQYIAQFTSQFLSLQCLQALY

SEQ ID NO: 343316 - protein, 23 aa, Homo sapiens
  Native (PRAME_HUMAN)
EEQYIAQFTSQFLSLQCLQALYV

SEQ ID NO: 343317 - protein, 24 aa, Homo sapiens
  Native (PRAME_HUMAN)
EEQYIAQFTSQFLSLQCLQALYVD

SEQ ID NO: 343318 - protein, 25 aa, Homo sapiens
  Native (PRAME_HUMAN)
EEQYIAQFTSQFLSLQCLQALYVDS

SEQ ID NO: 343319 - protein, 14 aa, Homo sapiens
  Native (PRAME_HUMAN)
EGACDELFSYLIEK

SEQ ID NO: 343320 - protein, 15 aa, Homo sapiens
  Native (PRAME_HUMAN)
EGACDELFSYLIEKV

SEQ ID NO: 343321 - protein, 16 aa, Homo sapiens
  Native (PRAME_HUMAN)
EGACDELFSYLIEKVK

SEQ ID NO: 343322 - protein, 17 aa, Homo sapiens
  Native (PRAME_HUMAN)
EGACDELFSYLIEKVKR

SEQ ID NO: 343323 - protein, 18 aa, Homo sapiens
  Native (PRAME_HUMAN)
EGACDELFSYLIEKVKRK

SEQ ID NO: 343324 - protein, 19 aa, Homo sapiens
  Native (PRAME_HUMAN)
EGACDELFSYLIEKVKRKK

SEQ ID NO: 343325 - protein, 20 aa, Homo sapiens
  Native (PRAME_HUMAN)
EGACDELFSYLIEKVKRKKN

SEQ ID NO: 343326 - protein, 21 aa, Homo sapiens
  Native (PRAME_HUMAN)
EGACDELFSYLIEKVKRKKNV

SEQ ID NO: 343327 - protein, 22 aa, Homo sapiens
  Native (PRAME_HUMAN)
EGACDELFSYLIEKVKRKKNVL

SEQ ID NO: 343328 - protein, 23 aa, Homo sapiens
  Native (PRAME_HUMAN)
EGACDELFSYLIEKVKRKKNVLR

SEQ ID NO: 343329 - protein, 24 aa, Homo sapiens
  Native (PRAME_HUMAN)
EGACDELFSYLIEKVKRKKNVLRL

SEQ ID NO: 343330 - protein, 25 aa, Homo sapiens
  Native (PRAME_HUMAN)
EGACDELFSYLIEKVKRKKNVLRLC

SEQ ID NO: 343331 - protein, 15 aa, Homo sapiens
  Native (PRAME_HUMAN)
EGDVMHLSQSPSVSQ

SEQ ID NO: 343332 - protein, 16 aa, Homo sapiens
  Native (PRAME_HUMAN)
EGDVMHLSQSPSVSQL

SEQ ID NO: 343333 - protein, 17 aa, Homo sapiens
  Native (PRAME_HUMAN)
EGDVMHLSQSPSVSQLS

SEQ ID NO: 343334 - protein, 18 aa, Homo sapiens
  Native (PRAME_HUMAN)
EGDVMHLSQSPSVSQLSV

SEQ ID NO: 343335 - protein, 19 aa, Homo sapiens
  Native (PRAME_HUMAN)
EGDVMHLSQSPSVSQLSVL

SEQ ID NO: 343336 - protein, 20 aa, Homo sapiens
  Native (PRAME_HUMAN)
EGDVMHLSQSPSVSQLSVLS

SEQ ID NO: 343337 - protein, 21 aa, Homo sapiens
  Native (PRAME_HUMAN)
EGDVMHLSQSPSVSQLSVLSL

SEQ ID NO: 343338 - protein, 22 aa, Homo sapiens
  Native (PRAME_HUMAN)
EGDVMHLSQSPSVSQLSVLSLS

SEQ ID NO: 343339 - protein, 23 aa, Homo sapiens
  Native (PRAME_HUMAN)
EGDVMHLSQSPSVSQLSVLSLSG

SEQ ID NO: 343340 - protein, 24 aa, Homo sapiens
  Native (PRAME_HUMAN)
EGDVMHLSQSPSVSQLSVLSLSGV

SEQ ID NO: 343341 - protein, 25 aa, Homo sapiens
  Native (PRAME_HUMAN)
EGDVMHLSQSPSVSQLSVLSLSGVM

SEQ ID NO: 343342 - protein, 14 aa, Homo sapiens
  Native (PRAME_HUMAN)
EKEEQYIAQFTSQF

SEQ ID NO: 343343 - protein, 15 aa, Homo sapiens
  Native (PRAME_HUMAN)
EKEEQYIAQFTSQFL

SEQ ID NO: 343344 - protein, 16 aa, Homo sapiens
  Native (PRAME_HUMAN)
EKEEQYIAQFTSQFLS

SEQ ID NO: 343345 - protein, 17 aa, Homo sapiens
  Native (PRAME_HUMAN)
EKEEQYIAQFTSQFLSL

SEQ ID NO: 343346 - protein, 18 aa, Homo sapiens
  Native (PRAME_HUMAN)
EKEEQYIAQFTSQFLSLQ

SEQ ID NO: 343347 - protein, 19 aa, Homo sapiens
  Native (PRAME_HUMAN)
EKEEQYIAQFTSQFLSLQC

SEQ ID NO: 343348 - protein, 20 aa, Homo sapiens
  Native (PRAME_HUMAN)
EKEEQYIAQFTSQFLSLQCL

SEQ ID NO: 343349 - protein, 21 aa, Homo sapiens
  Native (PRAME_HUMAN)
EKEEQYIAQFTSQFLSLQCLQ

SEQ ID NO: 343350 - protein, 22 aa, Homo sapiens
  Native (PRAME_HUMAN)
EKEEQYIAQFTSQFLSLQCLQA

SEQ ID NO: 343351 - protein, 23 aa, Homo sapiens
  Native (PRAME_HUMAN)
EKEEQYIAQFTSQFLSLQCLQAL

SEQ ID NO: 343352 - protein, 24 aa, Homo sapiens
  Native (PRAME_HUMAN)
EKEEQYIAQFTSQFLSLQCLQALY

SEQ ID NO: 343353 - protein, 25 aa, Homo sapiens
  Native (PRAME_HUMAN)
EKEEQYIAQFTSQFLSLQCLQALYV

SEQ ID NO: 343354 - protein, 14 aa, Homo sapiens
  Native (PRAME_HUMAN)
EKVKRKKNVLRLCC

SEQ ID NO: 343355 - protein, 15 aa, Homo sapiens
  Native (PRAME_HUMAN)
EKVKRKKNVLRLCCK

SEQ ID NO: 343356 - protein, 16 aa, Homo sapiens
  Native (PRAME_HUMAN)
EKVKRKKNVLRLCCKK

SEQ ID NO: 343357 - protein, 17 aa, Homo sapiens
  Native (PRAME_HUMAN)
EKVKRKKNVLRLCCKKL

SEQ ID NO: 343358 - protein, 18 aa, Homo sapiens
  Native (PRAME_HUMAN)
EKVKRKKNVLRLCCKKLK

SEQ ID NO: 343359 - protein, 19 aa, Homo sapiens
  Native (PRAME_HUMAN)
EKVKRKKNVLRLCCKKLKI

SEQ ID NO: 343360 - protein, 20 aa, Homo sapiens
  Native (PRAME_HUMAN)
EKVKRKKNVLRLCCKKLKIF

SEQ ID NO: 343361 - protein, 21 aa, Homo sapiens
  Native (PRAME_HUMAN)
EKVKRKKNVLRLCCKKLKIFA

SEQ ID NO: 343362 - protein, 22 aa, Homo sapiens
  Native (PRAME_HUMAN)
EKVKRKKNVLRLCCKKLKIFAM

SEQ ID NO: 343363 - protein, 23 aa, Homo sapiens
  Native (PRAME_HUMAN)
EKVKRKKNVLRLCCKKLKIFAMP

SEQ ID NO: 343364 - protein, 24 aa, Homo sapiens
  Native (PRAME_HUMAN)
EKVKRKKNVLRLCCKKLKIFAMPM

SEQ ID NO: 343365 - protein, 25 aa, Homo sapiens
  Native (PRAME_HUMAN)
EKVKRKKNVLRLCCKKLKIFAMPMQ

SEQ ID NO: 343366 - protein, 14 aa, Homo sapiens
  Native (PRAME_HUMAN)
ELAGQSLLKDEALA

SEQ ID NO: 343367 - protein, 15 aa, Homo sapiens
  Native (PRAME_HUMAN)
ELAGQSLLKDEALAI

SEQ ID NO: 343368 - protein, 16 aa, Homo sapiens
  Native (PRAME_HUMAN)
ELAGQSLLKDEALAIA

SEQ ID NO: 343369 - protein, 17 aa, Homo sapiens
  Native (PRAME_HUMAN)
ELAGQSLLKDEALAIAA

SEQ ID NO: 343370 - protein, 18 aa, Homo sapiens
  Native (PRAME_HUMAN)
ELAGQSLLKDEALAIAAL

SEQ ID NO: 343371 - protein, 19 aa, Homo sapiens
  Native (PRAME_HUMAN)
ELAGQSLLKDEALAIAALE

SEQ ID NO: 343372 - protein, 20 aa, Homo sapiens
  Native (PRAME_HUMAN)
ELAGQSLLKDEALAIAALEL

SEQ ID NO: 343373 - protein, 21 aa, Homo sapiens
  Native (PRAME_HUMAN)
ELAGQSLLKDEALAIAALELL

SEQ ID NO: 343374 - protein, 22 aa, Homo sapiens
  Native (PRAME_HUMAN)
ELAGQSLLKDEALAIAALELLP

SEQ ID NO: 343375 - protein, 23 aa, Homo sapiens
  Native (PRAME_HUMAN)
ELAGQSLLKDEALAIAALELLPR

SEQ ID NO: 343376 - protein, 24 aa, Homo sapiens
  Native (PRAME_HUMAN)
ELAGQSLLKDEALAIAALELLPRE

SEQ ID NO: 343377 - protein, 25 aa, Homo sapiens
  Native (PRAME_HUMAN)
ELAGQSLLKDEALAIAALELLPREL

SEQ ID NO: 343378 - protein, 14 aa, Homo sapiens
  Native (PRAME_HUMAN)
ELFPPLFMAAFDGR

SEQ ID NO: 343379 - protein, 15 aa, Homo sapiens
  Native (PRAME_HUMAN)
ELFPPLFMAAFDGRH

SEQ ID NO: 343380 - protein, 16 aa, Homo sapiens
  Native (PRAME_HUMAN)
ELFPPLFMAAFDGRHS

SEQ ID NO: 343381 - protein, 17 aa, Homo sapiens
  Native (PRAME_HUMAN)
ELFPPLFMAAFDGRHSQ

SEQ ID NO: 343382 - protein, 18 aa, Homo sapiens
  Native (PRAME_HUMAN)
ELFPPLFMAAFDGRHSQT

SEQ ID NO: 343383 - protein, 19 aa, Homo sapiens
  Native (PRAME_HUMAN)
ELFPPLFMAAFDGRHSQTL

SEQ ID NO: 343384 - protein, 20 aa, Homo sapiens
  Native (PRAME_HUMAN)
ELFPPLFMAAFDGRHSQTLK

SEQ ID NO: 343385 - protein, 21 aa, Homo sapiens
  Native (PRAME_HUMAN)
ELFPPLFMAAFDGRHSQTLKA

SEQ ID NO: 343386 - protein, 22 aa, Homo sapiens
  Native (PRAME_HUMAN)
ELFPPLFMAAFDGRHSQTLKAM

SEQ ID NO: 343387 - protein, 23 aa, Homo sapiens
  Native (PRAME_HUMAN)
ELFPPLFMAAFDGRHSQTLKAMV

SEQ ID NO: 343388 - protein, 24 aa, Homo sapiens
  Native (PRAME_HUMAN)
ELFPPLFMAAFDGRHSQTLKAMVQ

SEQ ID NO: 343389 - protein, 25 aa, Homo sapiens
  Native (PRAME_HUMAN)
ELFPPLFMAAFDGRHSQTLKAMVQA

SEQ ID NO: 343390 - protein, 13 aa, Homo sapiens
  Native (PRAME_HUMAN)
ELFSYLIEKVKRK

SEQ ID NO: 343391 - protein, 14 aa, Homo sapiens
  Native (PRAME_HUMAN)
ELFSYLIEKVKRKK

SEQ ID NO: 343392 - protein, 15 aa, Homo sapiens
  Native (PRAME_HUMAN)
ELFSYLIEKVKRKKN

SEQ ID NO: 343393 - protein, 16 aa, Homo sapiens
  Native (PRAME_HUMAN)
ELFSYLIEKVKRKKNV

SEQ ID NO: 343394 - protein, 17 aa, Homo sapiens
  Native (PRAME_HUMAN)
ELFSYLIEKVKRKKNVL

SEQ ID NO: 343395 - protein, 18 aa, Homo sapiens
  Native (PRAME_HUMAN)
ELFSYLIEKVKRKKNVLR

SEQ ID NO: 343396 - protein, 19 aa, Homo sapiens
  Native (PRAME_HUMAN)
ELFSYLIEKVKRKKNVLRL

SEQ ID NO: 343397 - protein, 20 aa, Homo sapiens
  Native (PRAME_HUMAN)
ELFSYLIEKVKRKKNVLRLC

SEQ ID NO: 343398 - protein, 21 aa, Homo sapiens
  Native (PRAME_HUMAN)
ELFSYLIEKVKRKKNVLRLCC

SEQ ID NO: 343399 - protein, 22 aa, Homo sapiens
  Native (PRAME_HUMAN)
ELFSYLIEKVKRKKNVLRLCCK

SEQ ID NO: 343400 - protein, 23 aa, Homo sapiens
  Native (PRAME_HUMAN)
ELFSYLIEKVKRKKNVLRLCCKK

SEQ ID NO: 343401 - protein, 24 aa, Homo sapiens
  Native (PRAME_HUMAN)
ELFSYLIEKVKRKKNVLRLCCKKL

SEQ ID NO: 343402 - protein, 25 aa, Homo sapiens
  Native (PRAME_HUMAN)
ELFSYLIEKVKRKKNVLRLCCKKLK

SEQ ID NO: 343403 - protein, 13 aa, Homo sapiens
  Native (PRAME_HUMAN)
ELGRPSMVWLSAN

SEQ ID NO: 343404 - protein, 14 aa, Homo sapiens
  Native (PRAME_HUMAN)
ELGRPSMVWLSANP

SEQ ID NO: 343405 - protein, 15 aa, Homo sapiens
  Native (PRAME_HUMAN)
ELGRPSMVWLSANPC

SEQ ID NO: 343406 - protein, 16 aa, Homo sapiens
  Native (PRAME_HUMAN)
ELGRPSMVWLSANPCP

SEQ ID NO: 343407 - protein, 17 aa, Homo sapiens
  Native (PRAME_HUMAN)
ELGRPSMVWLSANPCPH

SEQ ID NO: 343408 - protein, 18 aa, Homo sapiens
  Native (PRAME_HUMAN)
ELGRPSMVWLSANPCPHC

SEQ ID NO: 343409 - protein, 19 aa, Homo sapiens
  Native (PRAME_HUMAN)
ELGRPSMVWLSANPCPHCG

SEQ ID NO: 343410 - protein, 20 aa, Homo sapiens
  Native (PRAME_HUMAN)
ELGRPSMVWLSANPCPHCGD

SEQ ID NO: 343411 - protein, 21 aa, Homo sapiens
  Native (PRAME_HUMAN)
ELGRPSMVWLSANPCPHCGDR

SEQ ID NO: 343412 - protein, 22 aa, Homo sapiens
  Native (PRAME_HUMAN)
ELGRPSMVWLSANPCPHCGDRT

SEQ ID NO: 343413 - protein, 23 aa, Homo sapiens
  Native (PRAME_HUMAN)
ELGRPSMVWLSANPCPHCGDRTF

SEQ ID NO: 343414 - protein, 24 aa, Homo sapiens
  Native (PRAME_HUMAN)
ELGRPSMVWLSANPCPHCGDRTFY

SEQ ID NO: 343415 - protein, 25 aa, Homo sapiens
  Native (PRAME_HUMAN)
ELGRPSMVWLSANPCPHCGDRTFYD

SEQ ID NO: 343416 - protein, 14 aa, Homo sapiens
  Native (PRAME_HUMAN)
ELLCELGRPSMVWL

SEQ ID NO: 343417 - protein, 15 aa, Homo sapiens
  Native (PRAME_HUMAN)
ELLCELGRPSMVWLS

SEQ ID NO: 343418 - protein, 16 aa, Homo sapiens
  Native (PRAME_HUMAN)
ELLCELGRPSMVWLSA

SEQ ID NO: 343419 - protein, 17 aa, Homo sapiens
  Native (PRAME_HUMAN)
ELLCELGRPSMVWLSAN

SEQ ID NO: 343420 - protein, 18 aa, Homo sapiens
  Native (PRAME_HUMAN)
ELLCELGRPSMVWLSANP

SEQ ID NO: 343421 - protein, 19 aa, Homo sapiens
  Native (PRAME_HUMAN)
ELLCELGRPSMVWLSANPC

SEQ ID NO: 343422 - protein, 20 aa, Homo sapiens
  Native (PRAME_HUMAN)
ELLCELGRPSMVWLSANPCP

SEQ ID NO: 343423 - protein, 21 aa, Homo sapiens
  Native (PRAME_HUMAN)
ELLCELGRPSMVWLSANPCPH

SEQ ID NO: 343424 - protein, 22 aa, Homo sapiens
  Native (PRAME_HUMAN)
ELLCELGRPSMVWLSANPCPHC

SEQ ID NO: 343425 - protein, 23 aa, Homo sapiens
  Native (PRAME_HUMAN)
ELLCELGRPSMVWLSANPCPHCG

SEQ ID NO: 343426 - protein, 24 aa, Homo sapiens
  Native (PRAME_HUMAN)
ELLCELGRPSMVWLSANPCPHCGD

SEQ ID NO: 343427 - protein, 25 aa, Homo sapiens
  Native (PRAME_HUMAN)
ELLCELGRPSMVWLSANPCPHCGDR

SEQ ID NO: 343428 - protein, 13 aa, Homo sapiens
  Native (PRAME_HUMAN)
ELLPRELFPPLFM

SEQ ID NO: 343429 - protein, 14 aa, Homo sapiens
  Native (PRAME_HUMAN)
ELLPRELFPPLFMA

SEQ ID NO: 343430 - protein, 15 aa, Homo sapiens
  Native (PRAME_HUMAN)
ELLPRELFPPLFMAA

SEQ ID NO: 343431 - protein, 16 aa, Homo sapiens
  Native (PRAME_HUMAN)
ELLPRELFPPLFMAAF

SEQ ID NO: 343432 - protein, 17 aa, Homo sapiens
  Native (PRAME_HUMAN)
ELLPRELFPPLFMAAFD

SEQ ID NO: 343433 - protein, 18 aa, Homo sapiens
  Native (PRAME_HUMAN)
ELLPRELFPPLFMAAFDG

SEQ ID NO: 343434 - protein, 19 aa, Homo sapiens
  Native (PRAME_HUMAN)
ELLPRELFPPLFMAAFDGR

SEQ ID NO: 343435 - protein, 20 aa, Homo sapiens
  Native (PRAME_HUMAN)
ELLPRELFPPLFMAAFDGRH

SEQ ID NO: 343436 - protein, 21 aa, Homo sapiens
  Native (PRAME_HUMAN)
ELLPRELFPPLFMAAFDGRHS

SEQ ID NO: 343437 - protein, 22 aa, Homo sapiens
  Native (PRAME_HUMAN)
ELLPRELFPPLFMAAFDGRHSQ

SEQ ID NO: 343438 - protein, 23 aa, Homo sapiens
  Native (PRAME_HUMAN)
ELLPRELFPPLFMAAFDGRHSQT

SEQ ID NO: 343439 - protein, 24 aa, Homo sapiens
  Native (PRAME_HUMAN)
ELLPRELFPPLFMAAFDGRHSQTL

SEQ ID NO: 343440 - protein, 25 aa, Homo sapiens
  Native (PRAME_HUMAN)
ELLPRELFPPLFMAAFDGRHSQTLK

SEQ ID NO: 343441 - protein, 15 aa, Homo sapiens
  Native (PRAME_HUMAN)
EPEAAQPMTKKRKVD

SEQ ID NO: 343442 - protein, 20 aa, Homo sapiens
  Native (PRAME_HUMAN)
EPEAAQPMTKKRKVDGLSTE

SEQ ID NO: 343443 - protein, 25 aa, Homo sapiens
  Native (PRAME_HUMAN)
EPEAAQPMTKKRKVDGLSTEAEQPF

SEQ ID NO: 343444 - protein, 14 aa, Homo sapiens
  Native (PRAME_HUMAN)
EPLQALLERASATL

SEQ ID NO: 343445 - protein, 15 aa, Homo sapiens
  Native (PRAME_HUMAN)
EPLQALLERASATLQ

SEQ ID NO: 343446 - protein, 16 aa, Homo sapiens
  Native (PRAME_HUMAN)
EPLQALLERASATLQD

SEQ ID NO: 343447 - protein, 17 aa, Homo sapiens
  Native (PRAME_HUMAN)
EPLQALLERASATLQDL

SEQ ID NO: 343448 - protein, 18 aa, Homo sapiens
  Native (PRAME_HUMAN)
EPLQALLERASATLQDLV

SEQ ID NO: 343449 - protein, 19 aa, Homo sapiens
  Native (PRAME_HUMAN)
EPLQALLERASATLQDLVF

SEQ ID NO: 343450 - protein, 20 aa, Homo sapiens
  Native (PRAME_HUMAN)
EPLQALLERASATLQDLVFD

SEQ ID NO: 343451 - protein, 21 aa, Homo sapiens
  Native (PRAME_HUMAN)
EPLQALLERASATLQDLVFDE

SEQ ID NO: 343452 - protein, 22 aa, Homo sapiens
  Native (PRAME_HUMAN)
EPLQALLERASATLQDLVFDEC

SEQ ID NO: 343453 - protein, 23 aa, Homo sapiens
  Native (PRAME_HUMAN)
EPLQALLERASATLQDLVFDECG

SEQ ID NO: 343454 - protein, 24 aa, Homo sapiens
  Native (PRAME_HUMAN)
EPLQALLERASATLQDLVFDECGI

SEQ ID NO: 343455 - protein, 25 aa, Homo sapiens
  Native (PRAME_HUMAN)
EPLQALLERASATLQDLVFDECGIT

SEQ ID NO: 343456 - protein, 13 aa, Homo sapiens
  Native (PRAME_HUMAN)
EQPFIPVEVLVDL

SEQ ID NO: 343457 - protein, 14 aa, Homo sapiens
  Native (PRAME_HUMAN)
EQPFIPVEVLVDLF

SEQ ID NO: 343458 - protein, 15 aa, Homo sapiens
  Native (PRAME_HUMAN)
EQPFIPVEVLVDLFL

SEQ ID NO: 343459 - protein, 16 aa, Homo sapiens
  Native (PRAME_HUMAN)
EQPFIPVEVLVDLFLK

SEQ ID NO: 343460 - protein, 17 aa, Homo sapiens
  Native (PRAME_HUMAN)
EQPFIPVEVLVDLFLKE

SEQ ID NO: 343461 - protein, 18 aa, Homo sapiens
  Native (PRAME_HUMAN)
EQPFIPVEVLVDLFLKEG

SEQ ID NO: 343462 - protein, 19 aa, Homo sapiens
  Native (PRAME_HUMAN)
EQPFIPVEVLVDLFLKEGA

SEQ ID NO: 343463 - protein, 20 aa, Homo sapiens
  Native (PRAME_HUMAN)
EQPFIPVEVLVDLFLKEGAC

SEQ ID NO: 343464 - protein, 21 aa, Homo sapiens
  Native (PRAME_HUMAN)
EQPFIPVEVLVDLFLKEGACD

SEQ ID NO: 343465 - protein, 22 aa, Homo sapiens
  Native (PRAME_HUMAN)
EQPFIPVEVLVDLFLKEGACDE

SEQ ID NO: 343466 - protein, 23 aa, Homo sapiens
  Native (PRAME_HUMAN)
EQPFIPVEVLVDLFLKEGACDEL

SEQ ID NO: 343467 - protein, 24 aa, Homo sapiens
  Native (PRAME_HUMAN)
EQPFIPVEVLVDLFLKEGACDELF

SEQ ID NO: 343468 - protein, 25 aa, Homo sapiens
  Native (PRAME_HUMAN)
EQPFIPVEVLVDLFLKEGACDELFS

SEQ ID NO: 343469 - protein, 13 aa, Homo sapiens
  Native (PRAME_HUMAN)
EQYIAQFTSQFLS

SEQ ID NO: 343470 - protein, 14 aa, Homo sapiens
  Native (PRAME_HUMAN)
EQYIAQFTSQFLSL

SEQ ID NO: 343471 - protein, 16 aa, Homo sapiens
  Native (PRAME_HUMAN)
EQYIAQFTSQFLSLQC

SEQ ID NO: 343472 - protein, 17 aa, Homo sapiens
  Native (PRAME_HUMAN)
EQYIAQFTSQFLSLQCL

SEQ ID NO: 343473 - protein, 18 aa, Homo sapiens
  Native (PRAME_HUMAN)
EQYIAQFTSQFLSLQCLQ

SEQ ID NO: 343474 - protein, 19 aa, Homo sapiens
  Native (PRAME_HUMAN)
EQYIAQFTSQFLSLQCLQA

SEQ ID NO: 343475 - protein, 20 aa, Homo sapiens
  Native (PRAME_HUMAN)
EQYIAQFTSQFLSLQCLQAL

SEQ ID NO: 343476 - protein, 21 aa, Homo sapiens
  Native (PRAME_HUMAN)
EQYIAQFTSQFLSLQCLQALY

SEQ ID NO: 343477 - protein, 22 aa, Homo sapiens
  Native (PRAME_HUMAN)
EQYIAQFTSQFLSLQCLQALYV

SEQ ID NO: 343478 - protein, 23 aa, Homo sapiens
  Native (PRAME_HUMAN)
EQYIAQFTSQFLSLQCLQALYVD

SEQ ID NO: 343479 - protein, 24 aa, Homo sapiens
  Native (PRAME_HUMAN)
EQYIAQFTSQFLSLQCLQALYVDS

SEQ ID NO: 343480 - protein, 25 aa, Homo sapiens
  Native (PRAME_HUMAN)
EQYIAQFTSQFLSLQCLQALYVDSL

SEQ ID NO: 343481 - protein, 14 aa, Homo sapiens
  Native (PRAME_HUMAN)
ERASATLQDLVFDE

SEQ ID NO: 343482 - protein, 15 aa, Homo sapiens
  Native (PRAME_HUMAN)
ERASATLQDLVFDEC

SEQ ID NO: 343483 - protein, 16 aa, Homo sapiens
  Native (PRAME_HUMAN)
ERASATLQDLVFDECG

SEQ ID NO: 343484 - protein, 17 aa, Homo sapiens
  Native (PRAME_HUMAN)
ERASATLQDLVFDECGI

SEQ ID NO: 343485 - protein, 18 aa, Homo sapiens
  Native (PRAME_HUMAN)
ERASATLQDLVFDECGIT

SEQ ID NO: 343486 - protein, 19 aa, Homo sapiens
  Native (PRAME_HUMAN)
ERASATLQDLVFDECGITD

SEQ ID NO: 343487 - protein, 20 aa, Homo sapiens
  Native (PRAME_HUMAN)
ERASATLQDLVFDECGITDD

SEQ ID NO: 343488 - protein, 21 aa, Homo sapiens
  Native (PRAME_HUMAN)
ERASATLQDLVFDECGITDDQ

SEQ ID NO: 343489 - protein, 22 aa, Homo sapiens
  Native (PRAME_HUMAN)
ERASATLQDLVFDECGITDDQL

SEQ ID NO: 343490 - protein, 23 aa, Homo sapiens
  Native (PRAME_HUMAN)
ERASATLQDLVFDECGITDDQLL

SEQ ID NO: 343491 - protein, 24 aa, Homo sapiens
  Native (PRAME_HUMAN)
ERASATLQDLVFDECGITDDQLLA

SEQ ID NO: 343492 - protein, 25 aa, Homo sapiens
  Native (PRAME_HUMAN)
ERASATLQDLVFDECGITDDQLLAL

SEQ ID NO: 343493 - protein, 13 aa, Homo sapiens
  Native (PRAME_HUMAN)
ERLAYLHARLREL

SEQ ID NO: 343494 - protein, 14 aa, Homo sapiens
  Native (PRAME_HUMAN)
ERLAYLHARLRELL

SEQ ID NO: 343495 - protein, 15 aa, Homo sapiens
  Native (PRAME_HUMAN)
ERLAYLHARLRELLC

SEQ ID NO: 343496 - protein, 16 aa, Homo sapiens
  Native (PRAME_HUMAN)
ERLAYLHARLRELLCE

SEQ ID NO: 343497 - protein, 17 aa, Homo sapiens
  Native (PRAME_HUMAN)
ERLAYLHARLRELLCEL

SEQ ID NO: 343498 - protein, 18 aa, Homo sapiens
  Native (PRAME_HUMAN)
ERLAYLHARLRELLCELG

SEQ ID NO: 343499 - protein, 19 aa, Homo sapiens
  Native (PRAME_HUMAN)
ERLAYLHARLRELLCELGR

SEQ ID NO: 343500 - protein, 20 aa, Homo sapiens
  Native (PRAME_HUMAN)
ERLAYLHARLRELLCELGRP

SEQ ID NO: 343501 - protein, 21 aa, Homo sapiens
  Native (PRAME_HUMAN)
ERLAYLHARLRELLCELGRPS

SEQ ID NO: 343502 - protein, 22 aa, Homo sapiens
  Native (PRAME_HUMAN)
ERLAYLHARLRELLCELGRPSM

SEQ ID NO: 343503 - protein, 23 aa, Homo sapiens
  Native (PRAME_HUMAN)
ERLAYLHARLRELLCELGRPSMV

SEQ ID NO: 343504 - protein, 24 aa, Homo sapiens
  Native (PRAME_HUMAN)
ERLAYLHARLRELLCELGRPSMVW

SEQ ID NO: 343505 - protein, 25 aa, Homo sapiens
  Native (PRAME_HUMAN)
ERLAYLHARLRELLCELGRPSMVWL

SEQ ID NO: 343506 - protein, 13 aa, Homo sapiens
  Native (PRAME_HUMAN)
ERRRLWGSIQSRY

SEQ ID NO: 343507 - protein, 14 aa, Homo sapiens
  Native (PRAME_HUMAN)
ERRRLWGSIQSRYI

SEQ ID NO: 343508 - protein, 15 aa, Homo sapiens
  Native (PRAME_HUMAN)
ERRRLWGSIQSRYIS

SEQ ID NO: 343509 - protein, 16 aa, Homo sapiens
  Native (PRAME_HUMAN)
ERRRLWGSIQSRYISM

SEQ ID NO: 343510 - protein, 17 aa, Homo sapiens
  Native (PRAME_HUMAN)
ERRRLWGSIQSRYISMS

SEQ ID NO: 343511 - protein, 18 aa, Homo sapiens
  Native (PRAME_HUMAN)
ERRRLWGSIQSRYISMSV

SEQ ID NO: 343512 - protein, 19 aa, Homo sapiens
  Native (PRAME_HUMAN)
ERRRLWGSIQSRYISMSVW

SEQ ID NO: 343513 - protein, 20 aa, Homo sapiens
  Native (PRAME_HUMAN)
ERRRLWGSIQSRYISMSVWT

SEQ ID NO: 343514 - protein, 21 aa, Homo sapiens
  Native (PRAME_HUMAN)
ERRRLWGSIQSRYISMSVWTS

SEQ ID NO: 343515 - protein, 22 aa, Homo sapiens
  Native (PRAME_HUMAN)
ERRRLWGSIQSRYISMSVWTSP

SEQ ID NO: 343516 - protein, 23 aa, Homo sapiens
  Native (PRAME_HUMAN)
ERRRLWGSIQSRYISMSVWTSPR

SEQ ID NO: 343517 - protein, 24 aa, Homo sapiens
  Native (PRAME_HUMAN)
ERRRLWGSIQSRYISMSVWTSPRR

SEQ ID NO: 343518 - protein, 25 aa, Homo sapiens
  Native (PRAME_HUMAN)
ERRRLWGSIQSRYISMSVWTSPRRL

SEQ ID NO: 343519 - protein, 15 aa, Homo sapiens
  Native (PRAME_HUMAN)
ESYEDIHGTLHLERL

SEQ ID NO: 343520 - protein, 16 aa, Homo sapiens
  Native (PRAME_HUMAN)
ESYEDIHGTLHLERLA

SEQ ID NO: 343521 - protein, 17 aa, Homo sapiens
  Native (PRAME_HUMAN)
ESYEDIHGTLHLERLAY

SEQ ID NO: 343522 - protein, 18 aa, Homo sapiens
  Native (PRAME_HUMAN)
ESYEDIHGTLHLERLAYL

SEQ ID NO: 343523 - protein, 19 aa, Homo sapiens
  Native (PRAME_HUMAN)
ESYEDIHGTLHLERLAYLH

SEQ ID NO: 343524 - protein, 20 aa, Homo sapiens
  Native (PRAME_HUMAN)
ESYEDIHGTLHLERLAYLHA

SEQ ID NO: 343525 - protein, 21 aa, Homo sapiens
  Native (PRAME_HUMAN)
ESYEDIHGTLHLERLAYLHAR

SEQ ID NO: 343526 - protein, 22 aa, Homo sapiens
  Native (PRAME_HUMAN)
ESYEDIHGTLHLERLAYLHARL

SEQ ID NO: 343527 - protein, 23 aa, Homo sapiens
  Native (PRAME_HUMAN)
ESYEDIHGTLHLERLAYLHARLR

SEQ ID NO: 343528 - protein, 24 aa, Homo sapiens
  Native (PRAME_HUMAN)
ESYEDIHGTLHLERLAYLHARLRE

SEQ ID NO: 343529 - protein, 25 aa, Homo sapiens
  Native (PRAME_HUMAN)
ESYEDIHGTLHLERLAYLHARLREL

SEQ ID NO: 343530 - protein, 13 aa, Homo sapiens
  Native (PRAME_HUMAN)
ETFKAVLDGLDVL

SEQ ID NO: 343531 - protein, 14 aa, Homo sapiens
  Native (PRAME_HUMAN)
ETFKAVLDGLDVLL

SEQ ID NO: 343532 - protein, 15 aa, Homo sapiens
  Native (PRAME_HUMAN)
ETFKAVLDGLDVLLA

SEQ ID NO: 343533 - protein, 16 aa, Homo sapiens
  Native (PRAME_HUMAN)
ETFKAVLDGLDVLLAQ

SEQ ID NO: 343534 - protein, 17 aa, Homo sapiens
  Native (PRAME_HUMAN)
ETFKAVLDGLDVLLAQE

SEQ ID NO: 343535 - protein, 18 aa, Homo sapiens
  Native (PRAME_HUMAN)
ETFKAVLDGLDVLLAQEV

SEQ ID NO: 343536 - protein, 19 aa, Homo sapiens
  Native (PRAME_HUMAN)
ETFKAVLDGLDVLLAQEVR

SEQ ID NO: 343537 - protein, 20 aa, Homo sapiens
  Native (PRAME_HUMAN)
ETFKAVLDGLDVLLAQEVRP

SEQ ID NO: 343538 - protein, 21 aa, Homo sapiens
  Native (PRAME_HUMAN)
ETFKAVLDGLDVLLAQEVRPR

SEQ ID NO: 343539 - protein, 22 aa, Homo sapiens
  Native (PRAME_HUMAN)
ETFKAVLDGLDVLLAQEVRPRR

SEQ ID NO: 343540 - protein, 23 aa, Homo sapiens
  Native (PRAME_HUMAN)
ETFKAVLDGLDVLLAQEVRPRRW

SEQ ID NO: 343541 - protein, 24 aa, Homo sapiens
  Native (PRAME_HUMAN)
ETFKAVLDGLDVLLAQEVRPRRWK

SEQ ID NO: 343542 - protein, 25 aa, Homo sapiens
  Native (PRAME_HUMAN)
ETFKAVLDGLDVLLAQEVRPRRWKL

SEQ ID NO: 343543 - protein, 15 aa, Homo sapiens
  Native (PRAME_HUMAN)
ETLSITNCRLSEGDV

SEQ ID NO: 343544 - protein, 16 aa, Homo sapiens
  Native (PRAME_HUMAN)
ETLSITNCRLSEGDVM

SEQ ID NO: 343545 - protein, 17 aa, Homo sapiens
  Native (PRAME_HUMAN)
ETLSITNCRLSEGDVMH

SEQ ID NO: 343546 - protein, 19 aa, Homo sapiens
  Native (PRAME_HUMAN)
ETLSITNCRLSEGDVMHLS

SEQ ID NO: 343547 - protein, 20 aa, Homo sapiens
  Native (PRAME_HUMAN)
ETLSITNCRLSEGDVMHLSQ

SEQ ID NO: 343548 - protein, 21 aa, Homo sapiens
  Native (PRAME_HUMAN)
ETLSITNCRLSEGDVMHLSQS

SEQ ID NO: 343549 - protein, 22 aa, Homo sapiens
  Native (PRAME_HUMAN)
ETLSITNCRLSEGDVMHLSQSP

SEQ ID NO: 343550 - protein, 23 aa, Homo sapiens
  Native (PRAME_HUMAN)
ETLSITNCRLSEGDVMHLSQSPS

SEQ ID NO: 343551 - protein, 24 aa, Homo sapiens
  Native (PRAME_HUMAN)
ETLSITNCRLSEGDVMHLSQSPSV

SEQ ID NO: 343552 - protein, 25 aa, Homo sapiens
  Native (PRAME_HUMAN)
ETLSITNCRLSEGDVMHLSQSPSVS

SEQ ID NO: 343553 - protein, 13 aa, Homo sapiens
  Native (PRAME_HUMAN)
EVLVDLFLKEGAC

SEQ ID NO: 343554 - protein, 14 aa, Homo sapiens
  Native (PRAME_HUMAN)
EVLVDLFLKEGACD

SEQ ID NO: 343555 - protein, 15 aa, Homo sapiens
  Native (PRAME_HUMAN)
EVLVDLFLKEGACDE

SEQ ID NO: 343556 - protein, 16 aa, Homo sapiens
  Native (PRAME_HUMAN)
EVLVDLFLKEGACDEL

SEQ ID NO: 343557 - protein, 17 aa, Homo sapiens
  Native (PRAME_HUMAN)
EVLVDLFLKEGACDELF

SEQ ID NO: 343558 - protein, 18 aa, Homo sapiens
  Native (PRAME_HUMAN)
EVLVDLFLKEGACDELFS

SEQ ID NO: 343559 - protein, 19 aa, Homo sapiens
  Native (PRAME_HUMAN)
EVLVDLFLKEGACDELFSY

SEQ ID NO: 343560 - protein, 20 aa, Homo sapiens
  Native (PRAME_HUMAN)
EVLVDLFLKEGACDELFSYL

SEQ ID NO: 343561 - protein, 21 aa, Homo sapiens
  Native (PRAME_HUMAN)
EVLVDLFLKEGACDELFSYLI

SEQ ID NO: 343562 - protein, 22 aa, Homo sapiens
  Native (PRAME_HUMAN)
EVLVDLFLKEGACDELFSYLIE

SEQ ID NO: 343563 - protein, 23 aa, Homo sapiens
  Native (PRAME_HUMAN)
EVLVDLFLKEGACDELFSYLIEK

SEQ ID NO: 343564 - protein, 24 aa, Homo sapiens
  Native (PRAME_HUMAN)
EVLVDLFLKEGACDELFSYLIEKV

SEQ ID NO: 343565 - protein, 25 aa, Homo sapiens
  Native (PRAME_HUMAN)
EVLVDLFLKEGACDELFSYLIEKVK

SEQ ID NO: 343566 - protein, 14 aa, Homo sapiens
  Native (PRAME_HUMAN)
EVRPRRWKLQVLDL

SEQ ID NO: 343567 - protein, 15 aa, Homo sapiens
  Native (PRAME_HUMAN)
EVRPRRWKLQVLDLR

SEQ ID NO: 343568 - protein, 16 aa, Homo sapiens
  Native (PRAME_HUMAN)
EVRPRRWKLQVLDLRK

SEQ ID NO: 343569 - protein, 17 aa, Homo sapiens
  Native (PRAME_HUMAN)
EVRPRRWKLQVLDLRKN

SEQ ID NO: 343570 - protein, 18 aa, Homo sapiens
  Native (PRAME_HUMAN)
EVRPRRWKLQVLDLRKNS

SEQ ID NO: 343571 - protein, 19 aa, Homo sapiens
  Native (PRAME_HUMAN)
EVRPRRWKLQVLDLRKNSH

SEQ ID NO: 343572 - protein, 20 aa, Homo sapiens
  Native (PRAME_HUMAN)
EVRPRRWKLQVLDLRKNSHQ

SEQ ID NO: 343573 - protein, 21 aa, Homo sapiens
  Native (PRAME_HUMAN)
EVRPRRWKLQVLDLRKNSHQD

SEQ ID NO: 343574 - protein, 22 aa, Homo sapiens
  Native (PRAME_HUMAN)
EVRPRRWKLQVLDLRKNSHQDF

SEQ ID NO: 343575 - protein, 23 aa, Homo sapiens
  Native (PRAME_HUMAN)
EVRPRRWKLQVLDLRKNSHQDFW

SEQ ID NO: 343576 - protein, 24 aa, Homo sapiens
  Native (PRAME_HUMAN)
EVRPRRWKLQVLDLRKNSHQDFWT

SEQ ID NO: 343577 - protein, 25 aa, Homo sapiens
  Native (PRAME_HUMAN)
EVRPRRWKLQVLDLRKNSHQDFWTV

SEQ ID NO: 343578 - protein, 15 aa, Homo sapiens
  Native (PRAME_HUMAN)
EVTCTWKLPTLAKFS

SEQ ID NO: 343579 - protein, 16 aa, Homo sapiens
  Native (PRAME_HUMAN)
EVTCTWKLPTLAKFSP

SEQ ID NO: 343580 - protein, 17 aa, Homo sapiens
  Native (PRAME_HUMAN)
EVTCTWKLPTLAKFSPY

SEQ ID NO: 343581 - protein, 18 aa, Homo sapiens
  Native (PRAME_HUMAN)
EVTCTWKLPTLAKFSPYL

SEQ ID NO: 343582 - protein, 19 aa, Homo sapiens
  Native (PRAME_HUMAN)
EVTCTWKLPTLAKFSPYLG

SEQ ID NO: 343583 - protein, 20 aa, Homo sapiens
  Native (PRAME_HUMAN)
EVTCTWKLPTLAKFSPYLGQ

SEQ ID NO: 343584 - protein, 21 aa, Homo sapiens
  Native (PRAME_HUMAN)
EVTCTWKLPTLAKFSPYLGQM

SEQ ID NO: 343585 - protein, 22 aa, Homo sapiens
  Native (PRAME_HUMAN)
EVTCTWKLPTLAKFSPYLGQMI

SEQ ID NO: 343586 - protein, 23 aa, Homo sapiens
  Native (PRAME_HUMAN)
EVTCTWKLPTLAKFSPYLGQMIN

SEQ ID NO: 343587 - protein, 24 aa, Homo sapiens
  Native (PRAME_HUMAN)
EVTCTWKLPTLAKFSPYLGQMINL

SEQ ID NO: 343588 - protein, 25 aa, Homo sapiens
  Native (PRAME_HUMAN)
EVTCTWKLPTLAKFSPYLGQMINLR

SEQ ID NO: 343589 - protein, 14 aa, Homo sapiens
  Native (PRAME_HUMAN)
FAMPMQDIKMILKM

SEQ ID NO: 343590 - protein, 15 aa, Homo sapiens
  Native (PRAME_HUMAN)
FAMPMQDIKMILKMV

SEQ ID NO: 343591 - protein, 16 aa, Homo sapiens
  Native (PRAME_HUMAN)
FAMPMQDIKMILKMVQ

SEQ ID NO: 343592 - protein, 17 aa, Homo sapiens
  Native (PRAME_HUMAN)
FAMPMQDIKMILKMVQL

SEQ ID NO: 343593 - protein, 18 aa, Homo sapiens
  Native (PRAME_HUMAN)
FAMPMQDIKMILKMVQLD

SEQ ID NO: 343594 - protein, 19 aa, Homo sapiens
  Native (PRAME_HUMAN)
FAMPMQDIKMILKMVQLDS

SEQ ID NO: 343595 - protein, 20 aa, Homo sapiens
  Native (PRAME_HUMAN)
FAMPMQDIKMILKMVQLDSI

SEQ ID NO: 343596 - protein, 21 aa, Homo sapiens
  Native (PRAME_HUMAN)
FAMPMQDIKMILKMVQLDSIE

SEQ ID NO: 343597 - protein, 22 aa, Homo sapiens
  Native (PRAME_HUMAN)
FAMPMQDIKMILKMVQLDSIED

SEQ ID NO: 343598 - protein, 23 aa, Homo sapiens
  Native (PRAME_HUMAN)
FAMPMQDIKMILKMVQLDSIEDL

SEQ ID NO: 343599 - protein, 24 aa, Homo sapiens
  Native (PRAME_HUMAN)
FAMPMQDIKMILKMVQLDSIEDLE

SEQ ID NO: 343600 - protein, 25 aa, Homo sapiens
  Native (PRAME_HUMAN)
FAMPMQDIKMILKMVQLDSIEDLEV

SEQ ID NO: 343601 - protein, 14 aa, Homo sapiens
  Native (PRAME_HUMAN)
FDECGITDDQLLAL

SEQ ID NO: 343602 - protein, 15 aa, Homo sapiens
  Native (PRAME_HUMAN)
FDECGITDDQLLALL

SEQ ID NO: 343603 - protein, 16 aa, Homo sapiens
  Native (PRAME_HUMAN)
FDECGITDDQLLALLP

SEQ ID NO: 343604 - protein, 17 aa, Homo sapiens
  Native (PRAME_HUMAN)
FDECGITDDQLLALLPS

SEQ ID NO: 343605 - protein, 18 aa, Homo sapiens
  Native (PRAME_HUMAN)
FDECGITDDQLLALLPSL

SEQ ID NO: 343606 - protein, 19 aa, Homo sapiens
  Native (PRAME_HUMAN)
FDECGITDDQLLALLPSLS

SEQ ID NO: 343607 - protein, 20 aa, Homo sapiens
  Native (PRAME_HUMAN)
FDECGITDDQLLALLPSLSH

SEQ ID NO: 343608 - protein, 21 aa, Homo sapiens
  Native (PRAME_HUMAN)
FDECGITDDQLLALLPSLSHC

SEQ ID NO: 343609 - protein, 22 aa, Homo sapiens
  Native (PRAME_HUMAN)
FDECGITDDQLLALLPSLSHCS

SEQ ID NO: 343610 - protein, 23 aa, Homo sapiens
  Native (PRAME_HUMAN)
FDECGITDDQLLALLPSLSHCSQ

SEQ ID NO: 343611 - protein, 24 aa, Homo sapiens
  Native (PRAME_HUMAN)
FDECGITDDQLLALLPSLSHCSQL

SEQ ID NO: 343612 - protein, 25 aa, Homo sapiens
  Native (PRAME_HUMAN)
FDECGITDDQLLALLPSLSHCSQLT

SEQ ID NO: 343613 - protein, 14 aa, Homo sapiens
  Native (PRAME_HUMAN)
FDGRHSQTLKAMVQ

SEQ ID NO: 343614 - protein, 15 aa, Homo sapiens
  Native (PRAME_HUMAN)
FDGRHSQTLKAMVQA

SEQ ID NO: 343615 - protein, 16 aa, Homo sapiens
  Native (PRAME_HUMAN)
FDGRHSQTLKAMVQAW

SEQ ID NO: 343616 - protein, 17 aa, Homo sapiens
  Native (PRAME_HUMAN)
FDGRHSQTLKAMVQAWP

SEQ ID NO: 343617 - protein, 18 aa, Homo sapiens
  Native (PRAME_HUMAN)
FDGRHSQTLKAMVQAWPF

SEQ ID NO: 343618 - protein, 19 aa, Homo sapiens
  Native (PRAME_HUMAN)
FDGRHSQTLKAMVQAWPFT

SEQ ID NO: 343619 - protein, 20 aa, Homo sapiens
  Native (PRAME_HUMAN)
FDGRHSQTLKAMVQAWPFTC

SEQ ID NO: 343620 - protein, 21 aa, Homo sapiens
  Native (PRAME_HUMAN)
FDGRHSQTLKAMVQAWPFTCL

SEQ ID NO: 343621 - protein, 22 aa, Homo sapiens
  Native (PRAME_HUMAN)
FDGRHSQTLKAMVQAWPFTCLP

SEQ ID NO: 343622 - protein, 23 aa, Homo sapiens
  Native (PRAME_HUMAN)
FDGRHSQTLKAMVQAWPFTCLPL

SEQ ID NO: 343623 - protein, 24 aa, Homo sapiens
  Native (PRAME_HUMAN)
FDGRHSQTLKAMVQAWPFTCLPLG

SEQ ID NO: 343624 - protein, 25 aa, Homo sapiens
  Native (PRAME_HUMAN)
FDGRHSQTLKAMVQAWPFTCLPLGV

SEQ ID NO: 343625 - protein, 13 aa, Homo sapiens
  Native (PRAME_HUMAN)
FFLRGRLDQLLRH

SEQ ID NO: 343626 - protein, 14 aa, Homo sapiens
  Native (PRAME_HUMAN)
FFLRGRLDQLLRHV

SEQ ID NO: 343627 - protein, 15 aa, Homo sapiens
  Native (PRAME_HUMAN)
FFLRGRLDQLLRHVM

SEQ ID NO: 343628 - protein, 16 aa, Homo sapiens
  Native (PRAME_HUMAN)
FFLRGRLDQLLRHVMN

SEQ ID NO: 343629 - protein, 17 aa, Homo sapiens
  Native (PRAME_HUMAN)
FFLRGRLDQLLRHVMNP

SEQ ID NO: 343630 - protein, 18 aa, Homo sapiens
  Native (PRAME_HUMAN)
FFLRGRLDQLLRHVMNPL

SEQ ID NO: 343631 - protein, 19 aa, Homo sapiens
  Native (PRAME_HUMAN)
FFLRGRLDQLLRHVMNPLE

SEQ ID NO: 343632 - protein, 20 aa, Homo sapiens
  Native (PRAME_HUMAN)
FFLRGRLDQLLRHVMNPLET

SEQ ID NO: 343633 - protein, 21 aa, Homo sapiens
  Native (PRAME_HUMAN)
FFLRGRLDQLLRHVMNPLETL

SEQ ID NO: 343634 - protein, 22 aa, Homo sapiens
  Native (PRAME_HUMAN)
FFLRGRLDQLLRHVMNPLETLS

SEQ ID NO: 343635 - protein, 23 aa, Homo sapiens
  Native (PRAME_HUMAN)
FFLRGRLDQLLRHVMNPLETLSI

SEQ ID NO: 343636 - protein, 24 aa, Homo sapiens
  Native (PRAME_HUMAN)
FFLRGRLDQLLRHVMNPLETLSIT

SEQ ID NO: 343637 - protein, 25 aa, Homo sapiens
  Native (PRAME_HUMAN)
FFLRGRLDQLLRHVMNPLETLSITN

SEQ ID NO: 343638 - protein, 13 aa, Homo sapiens
  Native (PRAME_HUMAN)
FIPVEVLVDLFLK

SEQ ID NO: 343639 - protein, 14 aa, Homo sapiens
  Native (PRAME_HUMAN)
FIPVEVLVDLFLKE

SEQ ID NO: 343640 - protein, 15 aa, Homo sapiens
  Native (PRAME_HUMAN)
FIPVEVLVDLFLKEG

SEQ ID NO: 343641 - protein, 16 aa, Homo sapiens
  Native (PRAME_HUMAN)
FIPVEVLVDLFLKEGA

SEQ ID NO: 343642 - protein, 17 aa, Homo sapiens
  Native (PRAME_HUMAN)
FIPVEVLVDLFLKEGAC

SEQ ID NO: 343643 - protein, 18 aa, Homo sapiens
  Native (PRAME_HUMAN)
FIPVEVLVDLFLKEGACD

SEQ ID NO: 343644 - protein, 19 aa, Homo sapiens
  Native (PRAME_HUMAN)
FIPVEVLVDLFLKEGACDE

SEQ ID NO: 343645 - protein, 20 aa, Homo sapiens
  Native (PRAME_HUMAN)
FIPVEVLVDLFLKEGACDEL

SEQ ID NO: 343646 - protein, 21 aa, Homo sapiens
  Native (PRAME_HUMAN)
FIPVEVLVDLFLKEGACDELF

SEQ ID NO: 343647 - protein, 22 aa, Homo sapiens
  Native (PRAME_HUMAN)
FIPVEVLVDLFLKEGACDELFS

SEQ ID NO: 343648 - protein, 23 aa, Homo sapiens
  Native (PRAME_HUMAN)
FIPVEVLVDLFLKEGACDELFSY

SEQ ID NO: 343649 - protein, 24 aa, Homo sapiens
  Native (PRAME_HUMAN)
FIPVEVLVDLFLKEGACDELFSYL

SEQ ID NO: 343650 - protein, 25 aa, Homo sapiens
  Native (PRAME_HUMAN)
FIPVEVLVDLFLKEGACDELFSYLI

SEQ ID NO: 343651 - protein, 13 aa, Homo sapiens
  Native (PRAME_HUMAN)
FKAVLDGLDVLLA

SEQ ID NO: 343652 - protein, 14 aa, Homo sapiens
  Native (PRAME_HUMAN)
FKAVLDGLDVLLAQ

SEQ ID NO: 343653 - protein, 15 aa, Homo sapiens
  Native (PRAME_HUMAN)
FKAVLDGLDVLLAQE

SEQ ID NO: 343654 - protein, 16 aa, Homo sapiens
  Native (PRAME_HUMAN)
FKAVLDGLDVLLAQEV

SEQ ID NO: 343655 - protein, 17 aa, Homo sapiens
  Native (PRAME_HUMAN)
FKAVLDGLDVLLAQEVR

SEQ ID NO: 343656 - protein, 18 aa, Homo sapiens
  Native (PRAME_HUMAN)
FKAVLDGLDVLLAQEVRP

SEQ ID NO: 343657 - protein, 19 aa, Homo sapiens
  Native (PRAME_HUMAN)
FKAVLDGLDVLLAQEVRPR

SEQ ID NO: 343658 - protein, 20 aa, Homo sapiens
  Native (PRAME_HUMAN)
FKAVLDGLDVLLAQEVRPRR

SEQ ID NO: 343659 - protein, 21 aa, Homo sapiens
  Native (PRAME_HUMAN)
FKAVLDGLDVLLAQEVRPRRW

SEQ ID NO: 343660 - protein, 22 aa, Homo sapiens
  Native (PRAME_HUMAN)
FKAVLDGLDVLLAQEVRPRRWK

SEQ ID NO: 343661 - protein, 23 aa, Homo sapiens
  Native (PRAME_HUMAN)
FKAVLDGLDVLLAQEVRPRRWKL

SEQ ID NO: 343662 - protein, 24 aa, Homo sapiens
  Native (PRAME_HUMAN)
FKAVLDGLDVLLAQEVRPRRWKLQ

SEQ ID NO: 343663 - protein, 25 aa, Homo sapiens
  Native (PRAME_HUMAN)
FKAVLDGLDVLLAQEVRPRRWKLQV

SEQ ID NO: 343664 - protein, 15 aa, Homo sapiens
  Native (PRAME_HUMAN)
FLKEGACDELFSYLI

SEQ ID NO: 343665 - protein, 16 aa, Homo sapiens
  Native (PRAME_HUMAN)
FLKEGACDELFSYLIE

SEQ ID NO: 343666 - protein, 17 aa, Homo sapiens
  Native (PRAME_HUMAN)
FLKEGACDELFSYLIEK

SEQ ID NO: 343667 - protein, 18 aa, Homo sapiens
  Native (PRAME_HUMAN)
FLKEGACDELFSYLIEKV

SEQ ID NO: 343668 - protein, 19 aa, Homo sapiens
  Native (PRAME_HUMAN)
FLKEGACDELFSYLIEKVK

SEQ ID NO: 343669 - protein, 20 aa, Homo sapiens
  Native (PRAME_HUMAN)
FLKEGACDELFSYLIEKVKR

SEQ ID NO: 343670 - protein, 21 aa, Homo sapiens
  Native (PRAME_HUMAN)
FLKEGACDELFSYLIEKVKRK

SEQ ID NO: 343671 - protein, 22 aa, Homo sapiens
  Native (PRAME_HUMAN)
FLKEGACDELFSYLIEKVKRKK

SEQ ID NO: 343672 - protein, 23 aa, Homo sapiens
  Native (PRAME_HUMAN)
FLKEGACDELFSYLIEKVKRKKN

SEQ ID NO: 343673 - protein, 24 aa, Homo sapiens
  Native (PRAME_HUMAN)
FLKEGACDELFSYLIEKVKRKKNV

SEQ ID NO: 343674 - protein, 25 aa, Homo sapiens
  Native (PRAME_HUMAN)
FLKEGACDELFSYLIEKVKRKKNVL

SEQ ID NO: 343675 - protein, 13 aa, Homo sapiens
  Native (PRAME_HUMAN)
FLRGRLDQLLRHV

SEQ ID NO: 343676 - protein, 14 aa, Homo sapiens
  Native (PRAME_HUMAN)
FLRGRLDQLLRHVM

SEQ ID NO: 343677 - protein, 15 aa, Homo sapiens
  Native (PRAME_HUMAN)
FLRGRLDQLLRHVMN

SEQ ID NO: 343678 - protein, 16 aa, Homo sapiens
  Native (PRAME_HUMAN)
FLRGRLDQLLRHVMNP

SEQ ID NO: 343679 - protein, 17 aa, Homo sapiens
  Native (PRAME_HUMAN)
FLRGRLDQLLRHVMNPL

SEQ ID NO: 343680 - protein, 18 aa, Homo sapiens
  Native (PRAME_HUMAN)
FLRGRLDQLLRHVMNPLE

SEQ ID NO: 343681 - protein, 19 aa, Homo sapiens
  Native (PRAME_HUMAN)
FLRGRLDQLLRHVMNPLET

SEQ ID NO: 343682 - protein, 20 aa, Homo sapiens
  Native (PRAME_HUMAN)
FLRGRLDQLLRHVMNPLETL

SEQ ID NO: 343683 - protein, 21 aa, Homo sapiens
  Native (PRAME_HUMAN)
FLRGRLDQLLRHVMNPLETLS

SEQ ID NO: 343684 - protein, 22 aa, Homo sapiens
  Native (PRAME_HUMAN)
FLRGRLDQLLRHVMNPLETLSI

SEQ ID NO: 343685 - protein, 23 aa, Homo sapiens
  Native (PRAME_HUMAN)
FLRGRLDQLLRHVMNPLETLSIT

SEQ ID NO: 343686 - protein, 24 aa, Homo sapiens
  Native (PRAME_HUMAN)
FLRGRLDQLLRHVMNPLETLSITN

SEQ ID NO: 343687 - protein, 25 aa, Homo sapiens
  Native (PRAME_HUMAN)
FLRGRLDQLLRHVMNPLETLSITNC

SEQ ID NO: 343688 - protein, 13 aa, Homo sapiens
  Native (PRAME_HUMAN)
FLSLQCLQALYVD

SEQ ID NO: 343689 - protein, 14 aa, Homo sapiens
  Native (PRAME_HUMAN)
FLSLQCLQALYVDS

SEQ ID NO: 343690 - protein, 15 aa, Homo sapiens
  Native (PRAME_HUMAN)
FLSLQCLQALYVDSL

SEQ ID NO: 343691 - protein, 16 aa, Homo sapiens
  Native (PRAME_HUMAN)
FLSLQCLQALYVDSLF

SEQ ID NO: 343692 - protein, 17 aa, Homo sapiens
  Native (PRAME_HUMAN)
FLSLQCLQALYVDSLFF

SEQ ID NO: 343693 - protein, 18 aa, Homo sapiens
  Native (PRAME_HUMAN)
FLSLQCLQALYVDSLFFL

SEQ ID NO: 343694 - protein, 19 aa, Homo sapiens
  Native (PRAME_HUMAN)
FLSLQCLQALYVDSLFFLR

SEQ ID NO: 343695 - protein, 20 aa, Homo sapiens
  Native (PRAME_HUMAN)
FLSLQCLQALYVDSLFFLRG

SEQ ID NO: 343696 - protein, 21 aa, Homo sapiens
  Native (PRAME_HUMAN)
FLSLQCLQALYVDSLFFLRGR

SEQ ID NO: 343697 - protein, 22 aa, Homo sapiens
  Native (PRAME_HUMAN)
FLSLQCLQALYVDSLFFLRGRL

SEQ ID NO: 343698 - protein, 23 aa, Homo sapiens
  Native (PRAME_HUMAN)
FLSLQCLQALYVDSLFFLRGRLD

SEQ ID NO: 343699 - protein, 24 aa, Homo sapiens
  Native (PRAME_HUMAN)
FLSLQCLQALYVDSLFFLRGRLDQ

SEQ ID NO: 343700 - protein, 25 aa, Homo sapiens
  Native (PRAME_HUMAN)
FLSLQCLQALYVDSLFFLRGRLDQL

SEQ ID NO: 343701 - protein, 15 aa, Homo sapiens
  Native (PRAME_HUMAN)
FMAAFDGRHSQTLKA

SEQ ID NO: 343702 - protein, 16 aa, Homo sapiens
  Native (PRAME_HUMAN)
FMAAFDGRHSQTLKAM

SEQ ID NO: 343703 - protein, 17 aa, Homo sapiens
  Native (PRAME_HUMAN)
FMAAFDGRHSQTLKAMV

SEQ ID NO: 343704 - protein, 18 aa, Homo sapiens
  Native (PRAME_HUMAN)
FMAAFDGRHSQTLKAMVQ

SEQ ID NO: 343705 - protein, 19 aa, Homo sapiens
  Native (PRAME_HUMAN)
FMAAFDGRHSQTLKAMVQA

SEQ ID NO: 343706 - protein, 20 aa, Homo sapiens
  Native (PRAME_HUMAN)
FMAAFDGRHSQTLKAMVQAW

SEQ ID NO: 343707 - protein, 21 aa, Homo sapiens
  Native (PRAME_HUMAN)
FMAAFDGRHSQTLKAMVQAWP

SEQ ID NO: 343708 - protein, 22 aa, Homo sapiens
  Native (PRAME_HUMAN)
FMAAFDGRHSQTLKAMVQAWPF

SEQ ID NO: 343709 - protein, 23 aa, Homo sapiens
  Native (PRAME_HUMAN)
FMAAFDGRHSQTLKAMVQAWPFT

SEQ ID NO: 343710 - protein, 24 aa, Homo sapiens
  Native (PRAME_HUMAN)
FMAAFDGRHSQTLKAMVQAWPFTC

SEQ ID NO: 343711 - protein, 25 aa, Homo sapiens
  Native (PRAME_HUMAN)
FMAAFDGRHSQTLKAMVQAWPFTCL

SEQ ID NO: 343712 - protein, 14 aa, Homo sapiens
  Native (PRAME_HUMAN)
FPEPEAAQPMTKKR

SEQ ID NO: 343713 - protein, 15 aa, Homo sapiens
  Native (PRAME_HUMAN)
FPEPEAAQPMTKKRK

SEQ ID NO: 343714 - protein, 16 aa, Homo sapiens
  Native (PRAME_HUMAN)
FPEPEAAQPMTKKRKV

SEQ ID NO: 343715 - protein, 17 aa, Homo sapiens
  Native (PRAME_HUMAN)
FPEPEAAQPMTKKRKVD

SEQ ID NO: 343716 - protein, 20 aa, Homo sapiens
  Native (PRAME_HUMAN)
FPEPEAAQPMTKKRKVDGLS

SEQ ID NO: 343717 - protein, 25 aa, Homo sapiens
  Native (PRAME_HUMAN)
FPEPEAAQPMTKKRKVDGLSTEAEQ

SEQ ID NO: 343718 - protein, 14 aa, Homo sapiens
  Native (PRAME_HUMAN)
FPPLFMAAFDGRHS

SEQ ID NO: 343719 - protein, 15 aa, Homo sapiens
  Native (PRAME_HUMAN)
FPPLFMAAFDGRHSQ

SEQ ID NO: 343720 - protein, 16 aa, Homo sapiens
  Native (PRAME_HUMAN)
FPPLFMAAFDGRHSQT

SEQ ID NO: 343721 - protein, 17 aa, Homo sapiens
  Native (PRAME_HUMAN)
FPPLFMAAFDGRHSQTL

SEQ ID NO: 343722 - protein, 18 aa, Homo sapiens
  Native (PRAME_HUMAN)
FPPLFMAAFDGRHSQTLK

SEQ ID NO: 343723 - protein, 19 aa, Homo sapiens
  Native (PRAME_HUMAN)
FPPLFMAAFDGRHSQTLKA

SEQ ID NO: 343724 - protein, 20 aa, Homo sapiens
  Native (PRAME_HUMAN)
FPPLFMAAFDGRHSQTLKAM

SEQ ID NO: 343725 - protein, 21 aa, Homo sapiens
  Native (PRAME_HUMAN)
FPPLFMAAFDGRHSQTLKAMV

SEQ ID NO: 343726 - protein, 22 aa, Homo sapiens
  Native (PRAME_HUMAN)
FPPLFMAAFDGRHSQTLKAMVQ

SEQ ID NO: 343727 - protein, 23 aa, Homo sapiens
  Native (PRAME_HUMAN)
FPPLFMAAFDGRHSQTLKAMVQA

SEQ ID NO: 343728 - protein, 24 aa, Homo sapiens
  Native (PRAME_HUMAN)
FPPLFMAAFDGRHSQTLKAMVQAW

SEQ ID NO: 343729 - protein, 25 aa, Homo sapiens
  Native (PRAME_HUMAN)
FPPLFMAAFDGRHSQTLKAMVQAWP

SEQ ID NO: 343730 - protein, 13 aa, Homo sapiens
  Native (PRAME_HUMAN)
FSPYLGQMINLRR

SEQ ID NO: 343731 - protein, 14 aa, Homo sapiens
  Native (PRAME_HUMAN)
FSPYLGQMINLRRL

SEQ ID NO: 343732 - protein, 15 aa, Homo sapiens
  Native (PRAME_HUMAN)
FSPYLGQMINLRRLL

SEQ ID NO: 343733 - protein, 16 aa, Homo sapiens
  Native (PRAME_HUMAN)
FSPYLGQMINLRRLLL

SEQ ID NO: 343734 - protein, 17 aa, Homo sapiens
  Native (PRAME_HUMAN)
FSPYLGQMINLRRLLLS

SEQ ID NO: 343735 - protein, 18 aa, Homo sapiens
  Native (PRAME_HUMAN)
FSPYLGQMINLRRLLLSH

SEQ ID NO: 343736 - protein, 19 aa, Homo sapiens
  Native (PRAME_HUMAN)
FSPYLGQMINLRRLLLSHI

SEQ ID NO: 343737 - protein, 20 aa, Homo sapiens
  Native (PRAME_HUMAN)
FSPYLGQMINLRRLLLSHIH

SEQ ID NO: 343738 - protein, 21 aa, Homo sapiens
  Native (PRAME_HUMAN)
FSPYLGQMINLRRLLLSHIHA

SEQ ID NO: 343739 - protein, 22 aa, Homo sapiens
  Native (PRAME_HUMAN)
FSPYLGQMINLRRLLLSHIHAS

SEQ ID NO: 343740 - protein, 23 aa, Homo sapiens
  Native (PRAME_HUMAN)
FSPYLGQMINLRRLLLSHIHASS

SEQ ID NO: 343741 - protein, 24 aa, Homo sapiens
  Native (PRAME_HUMAN)
FSPYLGQMINLRRLLLSHIHASSY

SEQ ID NO: 343742 - protein, 25 aa, Homo sapiens
  Native (PRAME_HUMAN)
FSPYLGQMINLRRLLLSHIHASSYI

SEQ ID NO: 343743 - protein, 13 aa, Homo sapiens
  Native (PRAME_HUMAN)
FSYLIEKVKRKKN

SEQ ID NO: 343744 - protein, 14 aa, Homo sapiens
  Native (PRAME_HUMAN)
FSYLIEKVKRKKNV

SEQ ID NO: 343745 - protein, 15 aa, Homo sapiens
  Native (PRAME_HUMAN)
FSYLIEKVKRKKNVL

SEQ ID NO: 343746 - protein, 16 aa, Homo sapiens
  Native (PRAME_HUMAN)
FSYLIEKVKRKKNVLR

SEQ ID NO: 343747 - protein, 17 aa, Homo sapiens
  Native (PRAME_HUMAN)
FSYLIEKVKRKKNVLRL

SEQ ID NO: 343748 - protein, 18 aa, Homo sapiens
  Native (PRAME_HUMAN)
FSYLIEKVKRKKNVLRLC

SEQ ID NO: 343749 - protein, 19 aa, Homo sapiens
  Native (PRAME_HUMAN)
FSYLIEKVKRKKNVLRLCC

SEQ ID NO: 343750 - protein, 20 aa, Homo sapiens
  Native (PRAME_HUMAN)
FSYLIEKVKRKKNVLRLCCK

SEQ ID NO: 343751 - protein, 21 aa, Homo sapiens
  Native (PRAME_HUMAN)
FSYLIEKVKRKKNVLRLCCKK

SEQ ID NO: 343752 - protein, 22 aa, Homo sapiens
  Native (PRAME_HUMAN)
FSYLIEKVKRKKNVLRLCCKKL

SEQ ID NO: 343753 - protein, 23 aa, Homo sapiens
  Native (PRAME_HUMAN)
FSYLIEKVKRKKNVLRLCCKKLK

SEQ ID NO: 343754 - protein, 24 aa, Homo sapiens
  Native (PRAME_HUMAN)
FSYLIEKVKRKKNVLRLCCKKLKI

SEQ ID NO: 343755 - protein, 25 aa, Homo sapiens
  Native (PRAME_HUMAN)
FSYLIEKVKRKKNVLRLCCKKLKIF

SEQ ID NO: 343756 - protein, 14 aa, Homo sapiens
  Native (PRAME_HUMAN)
FTCLPLGVLMKGQH

SEQ ID NO: 343757 - protein, 15 aa, Homo sapiens
  Native (PRAME_HUMAN)
FTCLPLGVLMKGQHL

SEQ ID NO: 343758 - protein, 16 aa, Homo sapiens
  Native (PRAME_HUMAN)
FTCLPLGVLMKGQHLH

SEQ ID NO: 343759 - protein, 17 aa, Homo sapiens
  Native (PRAME_HUMAN)
FTCLPLGVLMKGQHLHL

SEQ ID NO: 343760 - protein, 18 aa, Homo sapiens
  Native (PRAME_HUMAN)
FTCLPLGVLMKGQHLHLE

SEQ ID NO: 343761 - protein, 19 aa, Homo sapiens
  Native (PRAME_HUMAN)
FTCLPLGVLMKGQHLHLET

SEQ ID NO: 343762 - protein, 20 aa, Homo sapiens
  Native (PRAME_HUMAN)
FTCLPLGVLMKGQHLHLETF

SEQ ID NO: 343763 - protein, 21 aa, Homo sapiens
  Native (PRAME_HUMAN)
FTCLPLGVLMKGQHLHLETFK

SEQ ID NO: 343764 - protein, 22 aa, Homo sapiens
  Native (PRAME_HUMAN)
FTCLPLGVLMKGQHLHLETFKA

SEQ ID NO: 343765 - protein, 23 aa, Homo sapiens
  Native (PRAME_HUMAN)
FTCLPLGVLMKGQHLHLETFKAV

SEQ ID NO: 343766 - protein, 24 aa, Homo sapiens
  Native (PRAME_HUMAN)
FTCLPLGVLMKGQHLHLETFKAVL

SEQ ID NO: 343767 - protein, 25 aa, Homo sapiens
  Native (PRAME_HUMAN)
FTCLPLGVLMKGQHLHLETFKAVLD

SEQ ID NO: 343768 - protein, 13 aa, Homo sapiens
  Native (PRAME_HUMAN)
FTSQFLSLQCLQA

SEQ ID NO: 343769 - protein, 14 aa, Homo sapiens
  Native (PRAME_HUMAN)
FTSQFLSLQCLQAL

SEQ ID NO: 343770 - protein, 15 aa, Homo sapiens
  Native (PRAME_HUMAN)
FTSQFLSLQCLQALY

SEQ ID NO: 343771 - protein, 16 aa, Homo sapiens
  Native (PRAME_HUMAN)
FTSQFLSLQCLQALYV

SEQ ID NO: 343772 - protein, 17 aa, Homo sapiens
  Native (PRAME_HUMAN)
FTSQFLSLQCLQALYVD

SEQ ID NO: 343773 - protein, 18 aa, Homo sapiens
  Native (PRAME_HUMAN)
FTSQFLSLQCLQALYVDS

SEQ ID NO: 343774 - protein, 19 aa, Homo sapiens
  Native (PRAME_HUMAN)
FTSQFLSLQCLQALYVDSL

SEQ ID NO: 343775 - protein, 20 aa, Homo sapiens
  Native (PRAME_HUMAN)
FTSQFLSLQCLQALYVDSLF

SEQ ID NO: 343776 - protein, 21 aa, Homo sapiens
  Native (PRAME_HUMAN)
FTSQFLSLQCLQALYVDSLFF

SEQ ID NO: 343777 - protein, 22 aa, Homo sapiens
  Native (PRAME_HUMAN)
FTSQFLSLQCLQALYVDSLFFL

SEQ ID NO: 343778 - protein, 23 aa, Homo sapiens
  Native (PRAME_HUMAN)
FTSQFLSLQCLQALYVDSLFFLR

SEQ ID NO: 343779 - protein, 24 aa, Homo sapiens
  Native (PRAME_HUMAN)
FTSQFLSLQCLQALYVDSLFFLRG

SEQ ID NO: 343780 - protein, 25 aa, Homo sapiens
  Native (PRAME_HUMAN)
FTSQFLSLQCLQALYVDSLFFLRGR

SEQ ID NO: 343781 - protein, 13 aa, Homo sapiens
  Native (PRAME_HUMAN)
FWTVWSGNRASLY

SEQ ID NO: 343782 - protein, 14 aa, Homo sapiens
  Native (PRAME_HUMAN)
FWTVWSGNRASLYS

SEQ ID NO: 343783 - protein, 15 aa, Homo sapiens
  Native (PRAME_HUMAN)
FWTVWSGNRASLYSF

SEQ ID NO: 343784 - protein, 16 aa, Homo sapiens
  Native (PRAME_HUMAN)
FWTVWSGNRASLYSFP

SEQ ID NO: 343785 - protein, 17 aa, Homo sapiens
  Native (PRAME_HUMAN)
FWTVWSGNRASLYSFPE

SEQ ID NO: 343786 - protein, 18 aa, Homo sapiens
  Native (PRAME_HUMAN)
FWTVWSGNRASLYSFPEP

SEQ ID NO: 343787 - protein, 19 aa, Homo sapiens
  Native (PRAME_HUMAN)
FWTVWSGNRASLYSFPEPE

SEQ ID NO: 343788 - protein, 20 aa, Homo sapiens
  Native (PRAME_HUMAN)
FWTVWSGNRASLYSFPEPEA

SEQ ID NO: 343789 - protein, 21 aa, Homo sapiens
  Native (PRAME_HUMAN)
FWTVWSGNRASLYSFPEPEAA

SEQ ID NO: 343790 - protein, 22 aa, Homo sapiens
  Native (PRAME_HUMAN)
FWTVWSGNRASLYSFPEPEAAQ

SEQ ID NO: 343791 - protein, 23 aa, Homo sapiens
  Native (PRAME_HUMAN)
FWTVWSGNRASLYSFPEPEAAQP

SEQ ID NO: 343792 - protein, 24 aa, Homo sapiens
  Native (PRAME_HUMAN)
FWTVWSGNRASLYSFPEPEAAQPM

SEQ ID NO: 343793 - protein, 25 aa, Homo sapiens
  Native (PRAME_HUMAN)
FWTVWSGNRASLYSFPEPEAAQPMT

SEQ ID NO: 343794 - protein, 13 aa, Homo sapiens
  Native (PRAME_HUMAN)
FYGNSISISALQS

SEQ ID NO: 343795 - protein, 14 aa, Homo sapiens
  Native (PRAME_HUMAN)
FYGNSISISALQSL

SEQ ID NO: 343796 - protein, 15 aa, Homo sapiens
  Native (PRAME_HUMAN)
FYGNSISISALQSLL

SEQ ID NO: 343797 - protein, 16 aa, Homo sapiens
  Native (PRAME_HUMAN)
FYGNSISISALQSLLQ

SEQ ID NO: 343798 - protein, 17 aa, Homo sapiens
  Native (PRAME_HUMAN)
FYGNSISISALQSLLQH

SEQ ID NO: 343799 - protein, 18 aa, Homo sapiens
  Native (PRAME_HUMAN)
FYGNSISISALQSLLQHL

SEQ ID NO: 343800 - protein, 19 aa, Homo sapiens
  Native (PRAME_HUMAN)
FYGNSISISALQSLLQHLI

SEQ ID NO: 343801 - protein, 20 aa, Homo sapiens
  Native (PRAME_HUMAN)
FYGNSISISALQSLLQHLIG

SEQ ID NO: 343802 - protein, 21 aa, Homo sapiens
  Native (PRAME_HUMAN)
FYGNSISISALQSLLQHLIGL

SEQ ID NO: 343803 - protein, 22 aa, Homo sapiens
  Native (PRAME_HUMAN)
FYGNSISISALQSLLQHLIGLS

SEQ ID NO: 343804 - protein, 23 aa, Homo sapiens
  Native (PRAME_HUMAN)
FYGNSISISALQSLLQHLIGLSN

SEQ ID NO: 343805 - protein, 24 aa, Homo sapiens
  Native (PRAME_HUMAN)
FYGNSISISALQSLLQHLIGLSNL

SEQ ID NO: 343806 - protein, 25 aa, Homo sapiens
  Native (PRAME_HUMAN)
FYGNSISISALQSLLQHLIGLSNLT

SEQ ID NO: 343807 - protein, 14 aa, Homo sapiens
  Native (PRAME_HUMAN)
GACDELFSYLIEKV

SEQ ID NO: 343808 - protein, 15 aa, Homo sapiens
  Native (PRAME_HUMAN)
GACDELFSYLIEKVK

SEQ ID NO: 343809 - protein, 16 aa, Homo sapiens
  Native (PRAME_HUMAN)
GACDELFSYLIEKVKR

SEQ ID NO: 343810 - protein, 17 aa, Homo sapiens
  Native (PRAME_HUMAN)
GACDELFSYLIEKVKRK

SEQ ID NO: 343811 - protein, 18 aa, Homo sapiens
  Native (PRAME_HUMAN)
GACDELFSYLIEKVKRKK

SEQ ID NO: 343812 - protein, 19 aa, Homo sapiens
  Native (PRAME_HUMAN)
GACDELFSYLIEKVKRKKN

SEQ ID NO: 343813 - protein, 20 aa, Homo sapiens
  Native (PRAME_HUMAN)
GACDELFSYLIEKVKRKKNV

SEQ ID NO: 343814 - protein, 21 aa, Homo sapiens
  Native (PRAME_HUMAN)
GACDELFSYLIEKVKRKKNVL

SEQ ID NO: 343815 - protein, 22 aa, Homo sapiens
  Native (PRAME_HUMAN)
GACDELFSYLIEKVKRKKNVLR

SEQ ID NO: 343816 - protein, 23 aa, Homo sapiens
  Native (PRAME_HUMAN)
GACDELFSYLIEKVKRKKNVLRL

SEQ ID NO: 343817 - protein, 24 aa, Homo sapiens
  Native (PRAME_HUMAN)
GACDELFSYLIEKVKRKKNVLRLC

SEQ ID NO: 343818 - protein, 25 aa, Homo sapiens
  Native (PRAME_HUMAN)
GACDELFSYLIEKVKRKKNVLRLCC

SEQ ID NO: 343819 - protein, 19 aa, Homo sapiens
  Native (PRAME_HUMAN)
GDRTFYDPEPILCPCFMPN

SEQ ID NO: 343820 - protein, 14 aa, Homo sapiens
  Native (PRAME_HUMAN)
GDVMHLSQSPSVSQ

SEQ ID NO: 343821 - protein, 15 aa, Homo sapiens
  Native (PRAME_HUMAN)
GDVMHLSQSPSVSQL

SEQ ID NO: 343822 - protein, 16 aa, Homo sapiens
  Native (PRAME_HUMAN)
GDVMHLSQSPSVSQLS

SEQ ID NO: 343823 - protein, 17 aa, Homo sapiens
  Native (PRAME_HUMAN)
GDVMHLSQSPSVSQLSV

SEQ ID NO: 343824 - protein, 18 aa, Homo sapiens
  Native (PRAME_HUMAN)
GDVMHLSQSPSVSQLSVL

SEQ ID NO: 343825 - protein, 19 aa, Homo sapiens
  Native (PRAME_HUMAN)
GDVMHLSQSPSVSQLSVLS

SEQ ID NO: 343826 - protein, 20 aa, Homo sapiens
  Native (PRAME_HUMAN)
GDVMHLSQSPSVSQLSVLSL

SEQ ID NO: 343827 - protein, 21 aa, Homo sapiens
  Native (PRAME_HUMAN)
GDVMHLSQSPSVSQLSVLSLS

SEQ ID NO: 343828 - protein, 22 aa, Homo sapiens
  Native (PRAME_HUMAN)
GDVMHLSQSPSVSQLSVLSLSG

SEQ ID NO: 343829 - protein, 23 aa, Homo sapiens
  Native (PRAME_HUMAN)
GDVMHLSQSPSVSQLSVLSLSGV

SEQ ID NO: 343830 - protein, 24 aa, Homo sapiens
  Native (PRAME_HUMAN)
GDVMHLSQSPSVSQLSVLSLSGVM

SEQ ID NO: 343831 - protein, 25 aa, Homo sapiens
  Native (PRAME_HUMAN)
GDVMHLSQSPSVSQLSVLSLSGVML

SEQ ID NO: 343832 - protein, 13 aa, Homo sapiens
  Native (PRAME_HUMAN)
GITDDQLLALLPS

SEQ ID NO: 343833 - protein, 14 aa, Homo sapiens
  Native (PRAME_HUMAN)
GITDDQLLALLPSL

SEQ ID NO: 343834 - protein, 15 aa, Homo sapiens
  Native (PRAME_HUMAN)
GITDDQLLALLPSLS

SEQ ID NO: 343835 - protein, 16 aa, Homo sapiens
  Native (PRAME_HUMAN)
GITDDQLLALLPSLSH

SEQ ID NO: 343836 - protein, 17 aa, Homo sapiens
  Native (PRAME_HUMAN)
GITDDQLLALLPSLSHC

SEQ ID NO: 343837 - protein, 18 aa, Homo sapiens
  Native (PRAME_HUMAN)
GITDDQLLALLPSLSHCS

SEQ ID NO: 343838 - protein, 19 aa, Homo sapiens
  Native (PRAME_HUMAN)
GITDDQLLALLPSLSHCSQ

SEQ ID NO: 343839 - protein, 20 aa, Homo sapiens
  Native (PRAME_HUMAN)
GITDDQLLALLPSLSHCSQL

SEQ ID NO: 343840 - protein, 21 aa, Homo sapiens
  Native (PRAME_HUMAN)
GITDDQLLALLPSLSHCSQLT

SEQ ID NO: 343841 - protein, 22 aa, Homo sapiens
  Native (PRAME_HUMAN)
GITDDQLLALLPSLSHCSQLTT

SEQ ID NO: 343842 - protein, 23 aa, Homo sapiens
  Native (PRAME_HUMAN)
GITDDQLLALLPSLSHCSQLTTL

SEQ ID NO: 343843 - protein, 24 aa, Homo sapiens
  Native (PRAME_HUMAN)
GITDDQLLALLPSLSHCSQLTTLS

SEQ ID NO: 343844 - protein, 25 aa, Homo sapiens
  Native (PRAME_HUMAN)
GITDDQLLALLPSLSHCSQLTTLSF

SEQ ID NO: 343845 - protein, 13 aa, Homo sapiens
  Native (PRAME_HUMAN)
GLDVLLAQEVRPR

SEQ ID NO: 343846 - protein, 14 aa, Homo sapiens
  Native (PRAME_HUMAN)
GLDVLLAQEVRPRR

SEQ ID NO: 343847 - protein, 15 aa, Homo sapiens
  Native (PRAME_HUMAN)
GLDVLLAQEVRPRRW

SEQ ID NO: 343848 - protein, 16 aa, Homo sapiens
  Native (PRAME_HUMAN)
GLDVLLAQEVRPRRWK

SEQ ID NO: 343849 - protein, 17 aa, Homo sapiens
  Native (PRAME_HUMAN)
GLDVLLAQEVRPRRWKL

SEQ ID NO: 343850 - protein, 18 aa, Homo sapiens
  Native (PRAME_HUMAN)
GLDVLLAQEVRPRRWKLQ

SEQ ID NO: 343851 - protein, 19 aa, Homo sapiens
  Native (PRAME_HUMAN)
GLDVLLAQEVRPRRWKLQV

SEQ ID NO: 343852 - protein, 20 aa, Homo sapiens
  Native (PRAME_HUMAN)
GLDVLLAQEVRPRRWKLQVL

SEQ ID NO: 343853 - protein, 21 aa, Homo sapiens
  Native (PRAME_HUMAN)
GLDVLLAQEVRPRRWKLQVLD

SEQ ID NO: 343854 - protein, 22 aa, Homo sapiens
  Native (PRAME_HUMAN)
GLDVLLAQEVRPRRWKLQVLDL

SEQ ID NO: 343855 - protein, 23 aa, Homo sapiens
  Native (PRAME_HUMAN)
GLDVLLAQEVRPRRWKLQVLDLR

SEQ ID NO: 343856 - protein, 24 aa, Homo sapiens
  Native (PRAME_HUMAN)
GLDVLLAQEVRPRRWKLQVLDLRK

SEQ ID NO: 343857 - protein, 25 aa, Homo sapiens
  Native (PRAME_HUMAN)
GLDVLLAQEVRPRRWKLQVLDLRKN

SEQ ID NO: 343858 - protein, 13 aa, Homo sapiens
  Native (PRAME_HUMAN)
GLSNLTHVLYPVP

SEQ ID NO: 343859 - protein, 14 aa, Homo sapiens
  Native (PRAME_HUMAN)
GLSNLTHVLYPVPL

SEQ ID NO: 343860 - protein, 15 aa, Homo sapiens
  Native (PRAME_HUMAN)
GLSNLTHVLYPVPLE

SEQ ID NO: 343861 - protein, 16 aa, Homo sapiens
  Native (PRAME_HUMAN)
GLSNLTHVLYPVPLES

SEQ ID NO: 343862 - protein, 17 aa, Homo sapiens
  Native (PRAME_HUMAN)
GLSNLTHVLYPVPLESY

SEQ ID NO: 343863 - protein, 18 aa, Homo sapiens
  Native (PRAME_HUMAN)
GLSNLTHVLYPVPLESYE

SEQ ID NO: 343864 - protein, 19 aa, Homo sapiens
  Native (PRAME_HUMAN)
GLSNLTHVLYPVPLESYED

SEQ ID NO: 343865 - protein, 20 aa, Homo sapiens
  Native (PRAME_HUMAN)
GLSNLTHVLYPVPLESYEDI

SEQ ID NO: 343866 - protein, 21 aa, Homo sapiens
  Native (PRAME_HUMAN)
GLSNLTHVLYPVPLESYEDIH

SEQ ID NO: 343867 - protein, 22 aa, Homo sapiens
  Native (PRAME_HUMAN)
GLSNLTHVLYPVPLESYEDIHG

SEQ ID NO: 343868 - protein, 23 aa, Homo sapiens
  Native (PRAME_HUMAN)
GLSNLTHVLYPVPLESYEDIHGT

SEQ ID NO: 343869 - protein, 24 aa, Homo sapiens
  Native (PRAME_HUMAN)
GLSNLTHVLYPVPLESYEDIHGTL

SEQ ID NO: 343870 - protein, 25 aa, Homo sapiens
  Native (PRAME_HUMAN)
GLSNLTHVLYPVPLESYEDIHGTLH

SEQ ID NO: 343871 - protein, 14 aa, Homo sapiens
  Native (PRAME_HUMAN)
GLSTEAEQPFIPVE

SEQ ID NO: 343872 - protein, 15 aa, Homo sapiens
  Native (PRAME_HUMAN)
GLSTEAEQPFIPVEV

SEQ ID NO: 343873 - protein, 16 aa, Homo sapiens
  Native (PRAME_HUMAN)
GLSTEAEQPFIPVEVL

SEQ ID NO: 343874 - protein, 17 aa, Homo sapiens
  Native (PRAME_HUMAN)
GLSTEAEQPFIPVEVLV

SEQ ID NO: 343875 - protein, 18 aa, Homo sapiens
  Native (PRAME_HUMAN)
GLSTEAEQPFIPVEVLVD

SEQ ID NO: 343876 - protein, 19 aa, Homo sapiens
  Native (PRAME_HUMAN)
GLSTEAEQPFIPVEVLVDL

SEQ ID NO: 343877 - protein, 20 aa, Homo sapiens
  Native (PRAME_HUMAN)
GLSTEAEQPFIPVEVLVDLF

SEQ ID NO: 343878 - protein, 21 aa, Homo sapiens
  Native (PRAME_HUMAN)
GLSTEAEQPFIPVEVLVDLFL

SEQ ID NO: 343879 - protein, 22 aa, Homo sapiens
  Native (PRAME_HUMAN)
GLSTEAEQPFIPVEVLVDLFLK

SEQ ID NO: 343880 - protein, 23 aa, Homo sapiens
  Native (PRAME_HUMAN)
GLSTEAEQPFIPVEVLVDLFLKE

SEQ ID NO: 343881 - protein, 24 aa, Homo sapiens
  Native (PRAME_HUMAN)
GLSTEAEQPFIPVEVLVDLFLKEG

SEQ ID NO: 343882 - protein, 25 aa, Homo sapiens
  Native (PRAME_HUMAN)
GLSTEAEQPFIPVEVLVDLFLKEGA

SEQ ID NO: 343883 - protein, 15 aa, Homo sapiens
  Native (PRAME_HUMAN)
GNRASLYSFPEPEAA

SEQ ID NO: 343884 - protein, 16 aa, Homo sapiens
  Native (PRAME_HUMAN)
GNRASLYSFPEPEAAQ

SEQ ID NO: 343885 - protein, 17 aa, Homo sapiens
  Native (PRAME_HUMAN)
GNRASLYSFPEPEAAQP

SEQ ID NO: 343886 - protein, 19 aa, Homo sapiens
  Native (PRAME_HUMAN)
GNRASLYSFPEPEAAQPMT

SEQ ID NO: 343887 - protein, 20 aa, Homo sapiens
  Native (PRAME_HUMAN)
GNRASLYSFPEPEAAQPMTK

SEQ ID NO: 343888 - protein, 21 aa, Homo sapiens
  Native (PRAME_HUMAN)
GNRASLYSFPEPEAAQPMTKK

SEQ ID NO: 343889 - protein, 22 aa, Homo sapiens
  Native (PRAME_HUMAN)
GNRASLYSFPEPEAAQPMTKKR

SEQ ID NO: 343890 - protein, 23 aa, Homo sapiens
  Native (PRAME_HUMAN)
GNRASLYSFPEPEAAQPMTKKRK

SEQ ID NO: 343891 - protein, 24 aa, Homo sapiens
  Native (PRAME_HUMAN)
GNRASLYSFPEPEAAQPMTKKRKV

SEQ ID NO: 343892 - protein, 25 aa, Homo sapiens
  Native (PRAME_HUMAN)
GNRASLYSFPEPEAAQPMTKKRKVD

SEQ ID NO: 343893 - protein, 13 aa, Homo sapiens
  Native (PRAME_HUMAN)
GNSISISALQSLL

SEQ ID NO: 343894 - protein, 14 aa, Homo sapiens
  Native (PRAME_HUMAN)
GNSISISALQSLLQ

SEQ ID NO: 343895 - protein, 15 aa, Homo sapiens
  Native (PRAME_HUMAN)
GNSISISALQSLLQH

SEQ ID NO: 343896 - protein, 16 aa, Homo sapiens
  Native (PRAME_HUMAN)
GNSISISALQSLLQHL

SEQ ID NO: 343897 - protein, 17 aa, Homo sapiens
  Native (PRAME_HUMAN)
GNSISISALQSLLQHLI

SEQ ID NO: 343898 - protein, 18 aa, Homo sapiens
  Native (PRAME_HUMAN)
GNSISISALQSLLQHLIG

SEQ ID NO: 343899 - protein, 19 aa, Homo sapiens
  Native (PRAME_HUMAN)
GNSISISALQSLLQHLIGL

SEQ ID NO: 343900 - protein, 20 aa, Homo sapiens
  Native (PRAME_HUMAN)
GNSISISALQSLLQHLIGLS

SEQ ID NO: 343901 - protein, 21 aa, Homo sapiens
  Native (PRAME_HUMAN)
GNSISISALQSLLQHLIGLSN

SEQ ID NO: 343902 - protein, 22 aa, Homo sapiens
  Native (PRAME_HUMAN)
GNSISISALQSLLQHLIGLSNL

SEQ ID NO: 343903 - protein, 23 aa, Homo sapiens
  Native (PRAME_HUMAN)
GNSISISALQSLLQHLIGLSNLT

SEQ ID NO: 343904 - protein, 24 aa, Homo sapiens
  Native (PRAME_HUMAN)
GNSISISALQSLLQHLIGLSNLTH

SEQ ID NO: 343905 - protein, 25 aa, Homo sapiens
  Native (PRAME_HUMAN)
GNSISISALQSLLQHLIGLSNLTHV

SEQ ID NO: 343906 - protein, 13 aa, Homo sapiens
  Native (PRAME_HUMAN)
GQHLHLETFKAVL

SEQ ID NO: 343907 - protein, 14 aa, Homo sapiens
  Native (PRAME_HUMAN)
GQHLHLETFKAVLD

SEQ ID NO: 343908 - protein, 15 aa, Homo sapiens
  Native (PRAME_HUMAN)
GQHLHLETFKAVLDG

SEQ ID NO: 343909 - protein, 16 aa, Homo sapiens
  Native (PRAME_HUMAN)
GQHLHLETFKAVLDGL

SEQ ID NO: 343910 - protein, 17 aa, Homo sapiens
  Native (PRAME_HUMAN)
GQHLHLETFKAVLDGLD

SEQ ID NO: 343911 - protein, 18 aa, Homo sapiens
  Native (PRAME_HUMAN)
GQHLHLETFKAVLDGLDV

SEQ ID NO: 343912 - protein, 19 aa, Homo sapiens
  Native (PRAME_HUMAN)
GQHLHLETFKAVLDGLDVL

SEQ ID NO: 343913 - protein, 20 aa, Homo sapiens
  Native (PRAME_HUMAN)
GQHLHLETFKAVLDGLDVLL

SEQ ID NO: 343914 - protein, 21 aa, Homo sapiens
  Native (PRAME_HUMAN)
GQHLHLETFKAVLDGLDVLLA

SEQ ID NO: 343915 - protein, 22 aa, Homo sapiens
  Native (PRAME_HUMAN)
GQHLHLETFKAVLDGLDVLLAQ

SEQ ID NO: 343916 - protein, 23 aa, Homo sapiens
  Native (PRAME_HUMAN)
GQHLHLETFKAVLDGLDVLLAQE

SEQ ID NO: 343917 - protein, 24 aa, Homo sapiens
  Native (PRAME_HUMAN)
GQHLHLETFKAVLDGLDVLLAQEV

SEQ ID NO: 343918 - protein, 25 aa, Homo sapiens
  Native (PRAME_HUMAN)
GQHLHLETFKAVLDGLDVLLAQEVR

SEQ ID NO: 343919 - protein, 13 aa, Homo sapiens
  Native (PRAME_HUMAN)
GQMINLRRLLLSH

SEQ ID NO: 343920 - protein, 14 aa, Homo sapiens
  Native (PRAME_HUMAN)
GQMINLRRLLLSHI

SEQ ID NO: 343921 - protein, 15 aa, Homo sapiens
  Native (PRAME_HUMAN)
GQMINLRRLLLSHIH

SEQ ID NO: 343922 - protein, 16 aa, Homo sapiens
  Native (PRAME_HUMAN)
GQMINLRRLLLSHIHA

SEQ ID NO: 343923 - protein, 17 aa, Homo sapiens
  Native (PRAME_HUMAN)
GQMINLRRLLLSHIHAS

SEQ ID NO: 343924 - protein, 18 aa, Homo sapiens
  Native (PRAME_HUMAN)
GQMINLRRLLLSHIHASS

SEQ ID NO: 343925 - protein, 19 aa, Homo sapiens
  Native (PRAME_HUMAN)
GQMINLRRLLLSHIHASSY

SEQ ID NO: 343926 - protein, 20 aa, Homo sapiens
  Native (PRAME_HUMAN)
GQMINLRRLLLSHIHASSYI

SEQ ID NO: 343927 - protein, 21 aa, Homo sapiens
  Native (PRAME_HUMAN)
GQMINLRRLLLSHIHASSYIS

SEQ ID NO: 343928 - protein, 22 aa, Homo sapiens
  Native (PRAME_HUMAN)
GQMINLRRLLLSHIHASSYISP

SEQ ID NO: 343929 - protein, 23 aa, Homo sapiens
  Native (PRAME_HUMAN)
GQMINLRRLLLSHIHASSYISPE

SEQ ID NO: 343930 - protein, 24 aa, Homo sapiens
  Native (PRAME_HUMAN)
GQMINLRRLLLSHIHASSYISPEK

SEQ ID NO: 343931 - protein, 25 aa, Homo sapiens
  Native (PRAME_HUMAN)
GQMINLRRLLLSHIHASSYISPEKE

SEQ ID NO: 343932 - protein, 13 aa, Homo sapiens
  Native (PRAME_HUMAN)
GQSLLKDEALAIA

SEQ ID NO: 343933 - protein, 14 aa, Homo sapiens
  Native (PRAME_HUMAN)
GQSLLKDEALAIAA

SEQ ID NO: 343934 - protein, 15 aa, Homo sapiens
  Native (PRAME_HUMAN)
GQSLLKDEALAIAAL

SEQ ID NO: 343935 - protein, 16 aa, Homo sapiens
  Native (PRAME_HUMAN)
GQSLLKDEALAIAALE

SEQ ID NO: 343936 - protein, 17 aa, Homo sapiens
  Native (PRAME_HUMAN)
GQSLLKDEALAIAALEL

SEQ ID NO: 343937 - protein, 18 aa, Homo sapiens
  Native (PRAME_HUMAN)
GQSLLKDEALAIAALELL

SEQ ID NO: 343938 - protein, 19 aa, Homo sapiens
  Native (PRAME_HUMAN)
GQSLLKDEALAIAALELLP

SEQ ID NO: 343939 - protein, 20 aa, Homo sapiens
  Native (PRAME_HUMAN)
GQSLLKDEALAIAALELLPR

SEQ ID NO: 343940 - protein, 21 aa, Homo sapiens
  Native (PRAME_HUMAN)
GQSLLKDEALAIAALELLPRE

SEQ ID NO: 343941 - protein, 22 aa, Homo sapiens
  Native (PRAME_HUMAN)
GQSLLKDEALAIAALELLPREL

SEQ ID NO: 343942 - protein, 23 aa, Homo sapiens
  Native (PRAME_HUMAN)
GQSLLKDEALAIAALELLPRELF

SEQ ID NO: 343943 - protein, 24 aa, Homo sapiens
  Native (PRAME_HUMAN)
GQSLLKDEALAIAALELLPRELFP

SEQ ID NO: 343944 - protein, 25 aa, Homo sapiens
  Native (PRAME_HUMAN)
GQSLLKDEALAIAALELLPRELFPP

SEQ ID NO: 343945 - protein, 15 aa, Homo sapiens
  Native (PRAME_HUMAN)
GRHSQTLKAMVQAWP

SEQ ID NO: 343946 - protein, 16 aa, Homo sapiens
  Native (PRAME_HUMAN)
GRHSQTLKAMVQAWPF

SEQ ID NO: 343947 - protein, 17 aa, Homo sapiens
  Native (PRAME_HUMAN)
GRHSQTLKAMVQAWPFT

SEQ ID NO: 343948 - protein, 18 aa, Homo sapiens
  Native (PRAME_HUMAN)
GRHSQTLKAMVQAWPFTC

SEQ ID NO: 343949 - protein, 19 aa, Homo sapiens
  Native (PRAME_HUMAN)
GRHSQTLKAMVQAWPFTCL

SEQ ID NO: 343950 - protein, 20 aa, Homo sapiens
  Native (PRAME_HUMAN)
GRHSQTLKAMVQAWPFTCLP

SEQ ID NO: 343951 - protein, 21 aa, Homo sapiens
  Native (PRAME_HUMAN)
GRHSQTLKAMVQAWPFTCLPL

SEQ ID NO: 343952 - protein, 22 aa, Homo sapiens
  Native (PRAME_HUMAN)
GRHSQTLKAMVQAWPFTCLPLG

SEQ ID NO: 343953 - protein, 23 aa, Homo sapiens
  Native (PRAME_HUMAN)
GRHSQTLKAMVQAWPFTCLPLGV

SEQ ID NO: 343954 - protein, 24 aa, Homo sapiens
  Native (PRAME_HUMAN)
GRHSQTLKAMVQAWPFTCLPLGVL

SEQ ID NO: 343955 - protein, 25 aa, Homo sapiens
  Native (PRAME_HUMAN)
GRHSQTLKAMVQAWPFTCLPLGVLM

SEQ ID NO: 343956 - protein, 14 aa, Homo sapiens
  Native (PRAME_HUMAN)
GRLDQLLRHVMNPL

SEQ ID NO: 343957 - protein, 15 aa, Homo sapiens
  Native (PRAME_HUMAN)
GRLDQLLRHVMNPLE

SEQ ID NO: 343958 - protein, 16 aa, Homo sapiens
  Native (PRAME_HUMAN)
GRLDQLLRHVMNPLET

SEQ ID NO: 343959 - protein, 17 aa, Homo sapiens
  Native (PRAME_HUMAN)
GRLDQLLRHVMNPLETL

SEQ ID NO: 343960 - protein, 18 aa, Homo sapiens
  Native (PRAME_HUMAN)
GRLDQLLRHVMNPLETLS

SEQ ID NO: 343961 - protein, 19 aa, Homo sapiens
  Native (PRAME_HUMAN)
GRLDQLLRHVMNPLETLSI

SEQ ID NO: 343962 - protein, 20 aa, Homo sapiens
  Native (PRAME_HUMAN)
GRLDQLLRHVMNPLETLSIT

SEQ ID NO: 343963 - protein, 21 aa, Homo sapiens
  Native (PRAME_HUMAN)
GRLDQLLRHVMNPLETLSITN

SEQ ID NO: 343964 - protein, 22 aa, Homo sapiens
  Native (PRAME_HUMAN)
GRLDQLLRHVMNPLETLSITNC

SEQ ID NO: 343965 - protein, 23 aa, Homo sapiens
  Native (PRAME_HUMAN)
GRLDQLLRHVMNPLETLSITNCR

SEQ ID NO: 343966 - protein, 24 aa, Homo sapiens
  Native (PRAME_HUMAN)
GRLDQLLRHVMNPLETLSITNCRL

SEQ ID NO: 343967 - protein, 25 aa, Homo sapiens
  Native (PRAME_HUMAN)
GRLDQLLRHVMNPLETLSITNCRLS

SEQ ID NO: 343968 - protein, 13 aa, Homo sapiens
  Native (PRAME_HUMAN)
GRPSMVWLSANPC

SEQ ID NO: 343969 - protein, 14 aa, Homo sapiens
  Native (PRAME_HUMAN)
GRPSMVWLSANPCP

SEQ ID NO: 343970 - protein, 15 aa, Homo sapiens
  Native (PRAME_HUMAN)
GRPSMVWLSANPCPH

SEQ ID NO: 343971 - protein, 16 aa, Homo sapiens
  Native (PRAME_HUMAN)
GRPSMVWLSANPCPHC

SEQ ID NO: 343972 - protein, 17 aa, Homo sapiens
  Native (PRAME_HUMAN)
GRPSMVWLSANPCPHCG

SEQ ID NO: 343973 - protein, 18 aa, Homo sapiens
  Native (PRAME_HUMAN)
GRPSMVWLSANPCPHCGD

SEQ ID NO: 343974 - protein, 19 aa, Homo sapiens
  Native (PRAME_HUMAN)
GRPSMVWLSANPCPHCGDR

SEQ ID NO: 343975 - protein, 20 aa, Homo sapiens
  Native (PRAME_HUMAN)
GRPSMVWLSANPCPHCGDRT

SEQ ID NO: 343976 - protein, 21 aa, Homo sapiens
  Native (PRAME_HUMAN)
GRPSMVWLSANPCPHCGDRTF

SEQ ID NO: 343977 - protein, 22 aa, Homo sapiens
  Native (PRAME_HUMAN)
GRPSMVWLSANPCPHCGDRTFY

SEQ ID NO: 343978 - protein, 23 aa, Homo sapiens
  Native (PRAME_HUMAN)
GRPSMVWLSANPCPHCGDRTFYD

SEQ ID NO: 343979 - protein, 24 aa, Homo sapiens
  Native (PRAME_HUMAN)
GRPSMVWLSANPCPHCGDRTFYDP

SEQ ID NO: 343980 - protein, 25 aa, Homo sapiens
  Native (PRAME_HUMAN)
GRPSMVWLSANPCPHCGDRTFYDPE

SEQ ID NO: 343981 - protein, 14 aa, Homo sapiens
  Native (PRAME_HUMAN)
GSIQSRYISMSVWT

SEQ ID NO: 343982 - protein, 15 aa, Homo sapiens
  Native (PRAME_HUMAN)
GSIQSRYISMSVWTS

SEQ ID NO: 343983 - protein, 16 aa, Homo sapiens
  Native (PRAME_HUMAN)
GSIQSRYISMSVWTSP

SEQ ID NO: 343984 - protein, 17 aa, Homo sapiens
  Native (PRAME_HUMAN)
GSIQSRYISMSVWTSPR

SEQ ID NO: 343985 - protein, 18 aa, Homo sapiens
  Native (PRAME_HUMAN)
GSIQSRYISMSVWTSPRR

SEQ ID NO: 343986 - protein, 19 aa, Homo sapiens
  Native (PRAME_HUMAN)
GSIQSRYISMSVWTSPRRL

SEQ ID NO: 343987 - protein, 20 aa, Homo sapiens
  Native (PRAME_HUMAN)
GSIQSRYISMSVWTSPRRLV

SEQ ID NO: 343988 - protein, 21 aa, Homo sapiens
  Native (PRAME_HUMAN)
GSIQSRYISMSVWTSPRRLVE

SEQ ID NO: 343989 - protein, 22 aa, Homo sapiens
  Native (PRAME_HUMAN)
GSIQSRYISMSVWTSPRRLVEL

SEQ ID NO: 343990 - protein, 23 aa, Homo sapiens
  Native (PRAME_HUMAN)
GSIQSRYISMSVWTSPRRLVELA

SEQ ID NO: 343991 - protein, 24 aa, Homo sapiens
  Native (PRAME_HUMAN)
GSIQSRYISMSVWTSPRRLVELAG

SEQ ID NO: 343992 - protein, 25 aa, Homo sapiens
  Native (PRAME_HUMAN)
GSIQSRYISMSVWTSPRRLVELAGQ

SEQ ID NO: 343993 - protein, 13 aa, Homo sapiens
  Native (PRAME_HUMAN)
GTLHLERLAYLHA

SEQ ID NO: 343994 - protein, 14 aa, Homo sapiens
  Native (PRAME_HUMAN)
GTLHLERLAYLHAR

SEQ ID NO: 343995 - protein, 15 aa, Homo sapiens
  Native (PRAME_HUMAN)
GTLHLERLAYLHARL

SEQ ID NO: 343996 - protein, 16 aa, Homo sapiens
  Native (PRAME_HUMAN)
GTLHLERLAYLHARLR

SEQ ID NO: 343997 - protein, 17 aa, Homo sapiens
  Native (PRAME_HUMAN)
GTLHLERLAYLHARLRE

SEQ ID NO: 343998 - protein, 18 aa, Homo sapiens
  Native (PRAME_HUMAN)
GTLHLERLAYLHARLREL

SEQ ID NO: 343999 - protein, 19 aa, Homo sapiens
  Native (PRAME_HUMAN)
GTLHLERLAYLHARLRELL

SEQ ID NO: 344000 - protein, 20 aa, Homo sapiens
  Native (PRAME_HUMAN)
GTLHLERLAYLHARLRELLC

SEQ ID NO: 344001 - protein, 21 aa, Homo sapiens
  Native (PRAME_HUMAN)
GTLHLERLAYLHARLRELLCE

SEQ ID NO: 344002 - protein, 22 aa, Homo sapiens
  Native (PRAME_HUMAN)
GTLHLERLAYLHARLRELLCEL

SEQ ID NO: 344003 - protein, 23 aa, Homo sapiens
  Native (PRAME_HUMAN)
GTLHLERLAYLHARLRELLCELG

SEQ ID NO: 344004 - protein, 24 aa, Homo sapiens
  Native (PRAME_HUMAN)
GTLHLERLAYLHARLRELLCELGR

SEQ ID NO: 344005 - protein, 25 aa, Homo sapiens
  Native (PRAME_HUMAN)
GTLHLERLAYLHARLRELLCELGRP

SEQ ID NO: 344006 - protein, 14 aa, Homo sapiens
  Native (PRAME_HUMAN)
GVLMKGQHLHLETF

SEQ ID NO: 344007 - protein, 15 aa, Homo sapiens
  Native (PRAME_HUMAN)
GVLMKGQHLHLETFK

SEQ ID NO: 344008 - protein, 16 aa, Homo sapiens
  Native (PRAME_HUMAN)
GVLMKGQHLHLETFKA

SEQ ID NO: 344009 - protein, 17 aa, Homo sapiens
  Native (PRAME_HUMAN)
GVLMKGQHLHLETFKAV

SEQ ID NO: 344010 - protein, 18 aa, Homo sapiens
  Native (PRAME_HUMAN)
GVLMKGQHLHLETFKAVL

SEQ ID NO: 344011 - protein, 19 aa, Homo sapiens
  Native (PRAME_HUMAN)
GVLMKGQHLHLETFKAVLD

SEQ ID NO: 344012 - protein, 20 aa, Homo sapiens
  Native (PRAME_HUMAN)
GVLMKGQHLHLETFKAVLDG

SEQ ID NO: 344013 - protein, 21 aa, Homo sapiens
  Native (PRAME_HUMAN)
GVLMKGQHLHLETFKAVLDGL

SEQ ID NO: 344014 - protein, 22 aa, Homo sapiens
  Native (PRAME_HUMAN)
GVLMKGQHLHLETFKAVLDGLD

SEQ ID NO: 344015 - protein, 23 aa, Homo sapiens
  Native (PRAME_HUMAN)
GVLMKGQHLHLETFKAVLDGLDV

SEQ ID NO: 344016 - protein, 24 aa, Homo sapiens
  Native (PRAME_HUMAN)
GVLMKGQHLHLETFKAVLDGLDVL

SEQ ID NO: 344017 - protein, 25 aa, Homo sapiens
  Native (PRAME_HUMAN)
GVLMKGQHLHLETFKAVLDGLDVLL

SEQ ID NO: 344018 - protein, 13 aa, Homo sapiens
  Native (PRAME_HUMAN)
GVMLTDVSPEPLQ

SEQ ID NO: 344019 - protein, 14 aa, Homo sapiens
  Native (PRAME_HUMAN)
GVMLTDVSPEPLQA

SEQ ID NO: 344020 - protein, 15 aa, Homo sapiens
  Native (PRAME_HUMAN)
GVMLTDVSPEPLQAL

SEQ ID NO: 344021 - protein, 16 aa, Homo sapiens
  Native (PRAME_HUMAN)
GVMLTDVSPEPLQALL

SEQ ID NO: 344022 - protein, 17 aa, Homo sapiens
  Native (PRAME_HUMAN)
GVMLTDVSPEPLQALLE

SEQ ID NO: 344023 - protein, 18 aa, Homo sapiens
  Native (PRAME_HUMAN)
GVMLTDVSPEPLQALLER

SEQ ID NO: 344024 - protein, 19 aa, Homo sapiens
  Native (PRAME_HUMAN)
GVMLTDVSPEPLQALLERA

SEQ ID NO: 344025 - protein, 20 aa, Homo sapiens
  Native (PRAME_HUMAN)
GVMLTDVSPEPLQALLERAS

SEQ ID NO: 344026 - protein, 21 aa, Homo sapiens
  Native (PRAME_HUMAN)
GVMLTDVSPEPLQALLERASA

SEQ ID NO: 344027 - protein, 22 aa, Homo sapiens
  Native (PRAME_HUMAN)
GVMLTDVSPEPLQALLERASAT

SEQ ID NO: 344028 - protein, 23 aa, Homo sapiens
  Native (PRAME_HUMAN)
GVMLTDVSPEPLQALLERASATL

SEQ ID NO: 344029 - protein, 24 aa, Homo sapiens
  Native (PRAME_HUMAN)
GVMLTDVSPEPLQALLERASATLQ

SEQ ID NO: 344030 - protein, 25 aa, Homo sapiens
  Native (PRAME_HUMAN)
GVMLTDVSPEPLQALLERASATLQD

SEQ ID NO: 344031 - protein, 14 aa, Homo sapiens
  Native (PRAME_HUMAN)
HARLRELLCELGRP

SEQ ID NO: 344032 - protein, 15 aa, Homo sapiens
  Native (PRAME_HUMAN)
HARLRELLCELGRPS

SEQ ID NO: 344033 - protein, 16 aa, Homo sapiens
  Native (PRAME_HUMAN)
HARLRELLCELGRPSM

SEQ ID NO: 344034 - protein, 17 aa, Homo sapiens
  Native (PRAME_HUMAN)
HARLRELLCELGRPSMV

SEQ ID NO: 344035 - protein, 18 aa, Homo sapiens
  Native (PRAME_HUMAN)
HARLRELLCELGRPSMVW

SEQ ID NO: 344036 - protein, 19 aa, Homo sapiens
  Native (PRAME_HUMAN)
HARLRELLCELGRPSMVWL

SEQ ID NO: 344037 - protein, 20 aa, Homo sapiens
  Native (PRAME_HUMAN)
HARLRELLCELGRPSMVWLS

SEQ ID NO: 344038 - protein, 21 aa, Homo sapiens
  Native (PRAME_HUMAN)
HARLRELLCELGRPSMVWLSA

SEQ ID NO: 344039 - protein, 22 aa, Homo sapiens
  Native (PRAME_HUMAN)
HARLRELLCELGRPSMVWLSAN

SEQ ID NO: 344040 - protein, 23 aa, Homo sapiens
  Native (PRAME_HUMAN)
HARLRELLCELGRPSMVWLSANP

SEQ ID NO: 344041 - protein, 24 aa, Homo sapiens
  Native (PRAME_HUMAN)
HARLRELLCELGRPSMVWLSANPC

SEQ ID NO: 344042 - protein, 25 aa, Homo sapiens
  Native (PRAME_HUMAN)
HARLRELLCELGRPSMVWLSANPCP

SEQ ID NO: 344043 - protein, 20 aa, Homo sapiens
  Native (PRAME_HUMAN)
HASSYISPEKEEQYIAQFTS

SEQ ID NO: 344044 - protein, 22 aa, Homo sapiens
  Native (PRAME_HUMAN)
HASSYISPEKEEQYIAQFTSQF

SEQ ID NO: 344045 - protein, 23 aa, Homo sapiens
  Native (PRAME_HUMAN)
HASSYISPEKEEQYIAQFTSQFL

SEQ ID NO: 344046 - protein, 24 aa, Homo sapiens
  Native (PRAME_HUMAN)
HASSYISPEKEEQYIAQFTSQFLS

SEQ ID NO: 344047 - protein, 25 aa, Homo sapiens
  Native (PRAME_HUMAN)
HASSYISPEKEEQYIAQFTSQFLSL

SEQ ID NO: 344048 - protein, 20 aa, Homo sapiens
  Native (PRAME_HUMAN)
HCGDRTFYDPEPILCPCFMP

SEQ ID NO: 344049 - protein, 21 aa, Homo sapiens
  Native (PRAME_HUMAN)
HCGDRTFYDPEPILCPCFMPN

SEQ ID NO: 344050 - protein, 14 aa, Homo sapiens
  Native (PRAME_HUMAN)
HCSQLTTLSFYGNS

SEQ ID NO: 344051 - protein, 15 aa, Homo sapiens
  Native (PRAME_HUMAN)
HCSQLTTLSFYGNSI

SEQ ID NO: 344052 - protein, 16 aa, Homo sapiens
  Native (PRAME_HUMAN)
HCSQLTTLSFYGNSIS

SEQ ID NO: 344053 - protein, 17 aa, Homo sapiens
  Native (PRAME_HUMAN)
HCSQLTTLSFYGNSISI

SEQ ID NO: 344054 - protein, 18 aa, Homo sapiens
  Native (PRAME_HUMAN)
HCSQLTTLSFYGNSISIS

SEQ ID NO: 344055 - protein, 19 aa, Homo sapiens
  Native (PRAME_HUMAN)
HCSQLTTLSFYGNSISISA

SEQ ID NO: 344056 - protein, 20 aa, Homo sapiens
  Native (PRAME_HUMAN)
HCSQLTTLSFYGNSISISAL

SEQ ID NO: 344057 - protein, 21 aa, Homo sapiens
  Native (PRAME_HUMAN)
HCSQLTTLSFYGNSISISALQ

SEQ ID NO: 344058 - protein, 22 aa, Homo sapiens
  Native (PRAME_HUMAN)
HCSQLTTLSFYGNSISISALQS

SEQ ID NO: 344059 - protein, 23 aa, Homo sapiens
  Native (PRAME_HUMAN)
HCSQLTTLSFYGNSISISALQSL

SEQ ID NO: 344060 - protein, 24 aa, Homo sapiens
  Native (PRAME_HUMAN)
HCSQLTTLSFYGNSISISALQSLL

SEQ ID NO: 344061 - protein, 25 aa, Homo sapiens
  Native (PRAME_HUMAN)
HCSQLTTLSFYGNSISISALQSLLQ

SEQ ID NO: 344062 - protein, 13 aa, Homo sapiens
  Native (PRAME_HUMAN)
HGTLHLERLAYLH

SEQ ID NO: 344063 - protein, 14 aa, Homo sapiens
  Native (PRAME_HUMAN)
HGTLHLERLAYLHA

SEQ ID NO: 344064 - protein, 15 aa, Homo sapiens
  Native (PRAME_HUMAN)
HGTLHLERLAYLHAR

SEQ ID NO: 344065 - protein, 16 aa, Homo sapiens
  Native (PRAME_HUMAN)
HGTLHLERLAYLHARL

SEQ ID NO: 344066 - protein, 17 aa, Homo sapiens
  Native (PRAME_HUMAN)
HGTLHLERLAYLHARLR

SEQ ID NO: 344067 - protein, 18 aa, Homo sapiens
  Native (PRAME_HUMAN)
HGTLHLERLAYLHARLRE

SEQ ID NO: 344068 - protein, 19 aa, Homo sapiens
  Native (PRAME_HUMAN)
HGTLHLERLAYLHARLREL

SEQ ID NO: 344069 - protein, 21 aa, Homo sapiens
  Native (PRAME_HUMAN)
HGTLHLERLAYLHARLRELLC

SEQ ID NO: 344070 - protein, 22 aa, Homo sapiens
  Native (PRAME_HUMAN)
HGTLHLERLAYLHARLRELLCE

SEQ ID NO: 344071 - protein, 23 aa, Homo sapiens
  Native (PRAME_HUMAN)
HGTLHLERLAYLHARLRELLCEL

SEQ ID NO: 344072 - protein, 24 aa, Homo sapiens
  Native (PRAME_HUMAN)
HGTLHLERLAYLHARLRELLCELG

SEQ ID NO: 344073 - protein, 25 aa, Homo sapiens
  Native (PRAME_HUMAN)
HGTLHLERLAYLHARLRELLCELGR

SEQ ID NO: 344074 - protein, 15 aa, Homo sapiens
  Native (PRAME_HUMAN)
HIHASSYISPEKEEQ

SEQ ID NO: 344075 - protein, 16 aa, Homo sapiens
  Native (PRAME_HUMAN)
HIHASSYISPEKEEQY

SEQ ID NO: 344076 - protein, 20 aa, Homo sapiens
  Native (PRAME_HUMAN)
HIHASSYISPEKEEQYIAQF

SEQ ID NO: 344077 - protein, 22 aa, Homo sapiens
  Native (PRAME_HUMAN)
HIHASSYISPEKEEQYIAQFTS

SEQ ID NO: 344078 - protein, 23 aa, Homo sapiens
  Native (PRAME_HUMAN)
HIHASSYISPEKEEQYIAQFTSQ

SEQ ID NO: 344079 - protein, 24 aa, Homo sapiens
  Native (PRAME_HUMAN)
HIHASSYISPEKEEQYIAQFTSQF

SEQ ID NO: 344080 - protein, 25 aa, Homo sapiens
  Native (PRAME_HUMAN)
HIHASSYISPEKEEQYIAQFTSQFL

SEQ ID NO: 344081 - protein, 13 aa, Homo sapiens
  Native (PRAME_HUMAN)
HLERLAYLHARLR

SEQ ID NO: 344082 - protein, 14 aa, Homo sapiens
  Native (PRAME_HUMAN)
HLERLAYLHARLRE

SEQ ID NO: 344083 - protein, 15 aa, Homo sapiens
  Native (PRAME_HUMAN)
HLERLAYLHARLREL

SEQ ID NO: 344084 - protein, 16 aa, Homo sapiens
  Native (PRAME_HUMAN)
HLERLAYLHARLRELL

SEQ ID NO: 344085 - protein, 17 aa, Homo sapiens
  Native (PRAME_HUMAN)
HLERLAYLHARLRELLC

SEQ ID NO: 344086 - protein, 18 aa, Homo sapiens
  Native (PRAME_HUMAN)
HLERLAYLHARLRELLCE

SEQ ID NO: 344087 - protein, 19 aa, Homo sapiens
  Native (PRAME_HUMAN)
HLERLAYLHARLRELLCEL

SEQ ID NO: 344088 - protein, 20 aa, Homo sapiens
  Native (PRAME_HUMAN)
HLERLAYLHARLRELLCELG

SEQ ID NO: 344089 - protein, 21 aa, Homo sapiens
  Native (PRAME_HUMAN)
HLERLAYLHARLRELLCELGR

SEQ ID NO: 344090 - protein, 22 aa, Homo sapiens
  Native (PRAME_HUMAN)
HLERLAYLHARLRELLCELGRP

SEQ ID NO: 344091 - protein, 23 aa, Homo sapiens
  Native (PRAME_HUMAN)
HLERLAYLHARLRELLCELGRPS

SEQ ID NO: 344092 - protein, 24 aa, Homo sapiens
  Native (PRAME_HUMAN)
HLERLAYLHARLRELLCELGRPSM

SEQ ID NO: 344093 - protein, 25 aa, Homo sapiens
  Native (PRAME_HUMAN)
HLERLAYLHARLRELLCELGRPSMV

SEQ ID NO: 344094 - protein, 13 aa, Homo sapiens
  Native (PRAME_HUMAN)
HLETFKAVLDGLD

SEQ ID NO: 344095 - protein, 14 aa, Homo sapiens
  Native (PRAME_HUMAN)
HLETFKAVLDGLDV

SEQ ID NO: 344096 - protein, 15 aa, Homo sapiens
  Native (PRAME_HUMAN)
HLETFKAVLDGLDVL

SEQ ID NO: 344097 - protein, 16 aa, Homo sapiens
  Native (PRAME_HUMAN)
HLETFKAVLDGLDVLL

SEQ ID NO: 344098 - protein, 17 aa, Homo sapiens
  Native (PRAME_HUMAN)
HLETFKAVLDGLDVLLA

SEQ ID NO: 344099 - protein, 18 aa, Homo sapiens
  Native (PRAME_HUMAN)
HLETFKAVLDGLDVLLAQ

SEQ ID NO: 344100 - protein, 19 aa, Homo sapiens
  Native (PRAME_HUMAN)
HLETFKAVLDGLDVLLAQE

SEQ ID NO: 344101 - protein, 20 aa, Homo sapiens
  Native (PRAME_HUMAN)
HLETFKAVLDGLDVLLAQEV

SEQ ID NO: 344102 - protein, 21 aa, Homo sapiens
  Native (PRAME_HUMAN)
HLETFKAVLDGLDVLLAQEVR

SEQ ID NO: 344103 - protein, 22 aa, Homo sapiens
  Native (PRAME_HUMAN)
HLETFKAVLDGLDVLLAQEVRP

SEQ ID NO: 344104 - protein, 23 aa, Homo sapiens
  Native (PRAME_HUMAN)
HLETFKAVLDGLDVLLAQEVRPR

SEQ ID NO: 344105 - protein, 24 aa, Homo sapiens
  Native (PRAME_HUMAN)
HLETFKAVLDGLDVLLAQEVRPRR

SEQ ID NO: 344106 - protein, 25 aa, Homo sapiens
  Native (PRAME_HUMAN)
HLETFKAVLDGLDVLLAQEVRPRRW

SEQ ID NO: 344107 - protein, 13 aa, Homo sapiens
  Native (PRAME_HUMAN)
HLHLETFKAVLDG

SEQ ID NO: 344108 - protein, 14 aa, Homo sapiens
  Native (PRAME_HUMAN)
HLHLETFKAVLDGL

SEQ ID NO: 344109 - protein, 15 aa, Homo sapiens
  Native (PRAME_HUMAN)
HLHLETFKAVLDGLD

SEQ ID NO: 344110 - protein, 16 aa, Homo sapiens
  Native (PRAME_HUMAN)
HLHLETFKAVLDGLDV

SEQ ID NO: 344111 - protein, 17 aa, Homo sapiens
  Native (PRAME_HUMAN)
HLHLETFKAVLDGLDVL

SEQ ID NO: 344112 - protein, 18 aa, Homo sapiens
  Native (PRAME_HUMAN)
HLHLETFKAVLDGLDVLL

SEQ ID NO: 344113 - protein, 19 aa, Homo sapiens
  Native (PRAME_HUMAN)
HLHLETFKAVLDGLDVLLA

SEQ ID NO: 344114 - protein, 20 aa, Homo sapiens
  Native (PRAME_HUMAN)
HLHLETFKAVLDGLDVLLAQ

SEQ ID NO: 344115 - protein, 21 aa, Homo sapiens
  Native (PRAME_HUMAN)
HLHLETFKAVLDGLDVLLAQE

SEQ ID NO: 344116 - protein, 22 aa, Homo sapiens
  Native (PRAME_HUMAN)
HLHLETFKAVLDGLDVLLAQEV

SEQ ID NO: 344117 - protein, 23 aa, Homo sapiens
  Native (PRAME_HUMAN)
HLHLETFKAVLDGLDVLLAQEVR

SEQ ID NO: 344118 - protein, 24 aa, Homo sapiens
  Native (PRAME_HUMAN)
HLHLETFKAVLDGLDVLLAQEVRP

SEQ ID NO: 344119 - protein, 25 aa, Homo sapiens
  Native (PRAME_HUMAN)
HLHLETFKAVLDGLDVLLAQEVRPR

SEQ ID NO: 344120 - protein, 13 aa, Homo sapiens
  Native (PRAME_HUMAN)
HLIGLSNLTHVLY

SEQ ID NO: 344121 - protein, 14 aa, Homo sapiens
  Native (PRAME_HUMAN)
HLIGLSNLTHVLYP

SEQ ID NO: 344122 - protein, 15 aa, Homo sapiens
  Native (PRAME_HUMAN)
HLIGLSNLTHVLYPV

SEQ ID NO: 344123 - protein, 16 aa, Homo sapiens
  Native (PRAME_HUMAN)
HLIGLSNLTHVLYPVP

SEQ ID NO: 344124 - protein, 17 aa, Homo sapiens
  Native (PRAME_HUMAN)
HLIGLSNLTHVLYPVPL

SEQ ID NO: 344125 - protein, 18 aa, Homo sapiens
  Native (PRAME_HUMAN)
HLIGLSNLTHVLYPVPLE

SEQ ID NO: 344126 - protein, 19 aa, Homo sapiens
  Native (PRAME_HUMAN)
HLIGLSNLTHVLYPVPLES

SEQ ID NO: 344127 - protein, 20 aa, Homo sapiens
  Native (PRAME_HUMAN)
HLIGLSNLTHVLYPVPLESY

SEQ ID NO: 344128 - protein, 21 aa, Homo sapiens
  Native (PRAME_HUMAN)
HLIGLSNLTHVLYPVPLESYE

SEQ ID NO: 344129 - protein, 22 aa, Homo sapiens
  Native (PRAME_HUMAN)
HLIGLSNLTHVLYPVPLESYED

SEQ ID NO: 344130 - protein, 23 aa, Homo sapiens
  Native (PRAME_HUMAN)
HLIGLSNLTHVLYPVPLESYEDI

SEQ ID NO: 344131 - protein, 24 aa, Homo sapiens
  Native (PRAME_HUMAN)
HLIGLSNLTHVLYPVPLESYEDIH

SEQ ID NO: 344132 - protein, 25 aa, Homo sapiens
  Native (PRAME_HUMAN)
HLIGLSNLTHVLYPVPLESYEDIHG

SEQ ID NO: 344133 - protein, 14 aa, Homo sapiens
  Native (PRAME_HUMAN)
HLSQSPSVSQLSVL

SEQ ID NO: 344134 - protein, 15 aa, Homo sapiens
  Native (PRAME_HUMAN)
HLSQSPSVSQLSVLS

SEQ ID NO: 344135 - protein, 16 aa, Homo sapiens
  Native (PRAME_HUMAN)
HLSQSPSVSQLSVLSL

SEQ ID NO: 344136 - protein, 17 aa, Homo sapiens
  Native (PRAME_HUMAN)
HLSQSPSVSQLSVLSLS

SEQ ID NO: 344137 - protein, 18 aa, Homo sapiens
  Native (PRAME_HUMAN)
HLSQSPSVSQLSVLSLSG

SEQ ID NO: 344138 - protein, 19 aa, Homo sapiens
  Native (PRAME_HUMAN)
HLSQSPSVSQLSVLSLSGV

SEQ ID NO: 344139 - protein, 20 aa, Homo sapiens
  Native (PRAME_HUMAN)
HLSQSPSVSQLSVLSLSGVM

SEQ ID NO: 344140 - protein, 21 aa, Homo sapiens
  Native (PRAME_HUMAN)
HLSQSPSVSQLSVLSLSGVML

SEQ ID NO: 344141 - protein, 22 aa, Homo sapiens
  Native (PRAME_HUMAN)
HLSQSPSVSQLSVLSLSGVMLT

SEQ ID NO: 344142 - protein, 23 aa, Homo sapiens
  Native (PRAME_HUMAN)
HLSQSPSVSQLSVLSLSGVMLTD

SEQ ID NO: 344143 - protein, 24 aa, Homo sapiens
  Native (PRAME_HUMAN)
HLSQSPSVSQLSVLSLSGVMLTDV

SEQ ID NO: 344144 - protein, 25 aa, Homo sapiens
  Native (PRAME_HUMAN)
HLSQSPSVSQLSVLSLSGVMLTDVS

SEQ ID NO: 344145 - protein, 14 aa, Homo sapiens
  Native (PRAME_HUMAN)
HQDFWTVWSGNRAS

SEQ ID NO: 344146 - protein, 15 aa, Homo sapiens
  Native (PRAME_HUMAN)
HQDFWTVWSGNRASL

SEQ ID NO: 344147 - protein, 16 aa, Homo sapiens
  Native (PRAME_HUMAN)
HQDFWTVWSGNRASLY

SEQ ID NO: 344148 - protein, 17 aa, Homo sapiens
  Native (PRAME_HUMAN)
HQDFWTVWSGNRASLYS

SEQ ID NO: 344149 - protein, 18 aa, Homo sapiens
  Native (PRAME_HUMAN)
HQDFWTVWSGNRASLYSF

SEQ ID NO: 344150 - protein, 19 aa, Homo sapiens
  Native (PRAME_HUMAN)
HQDFWTVWSGNRASLYSFP

SEQ ID NO: 344151 - protein, 20 aa, Homo sapiens
  Native (PRAME_HUMAN)
HQDFWTVWSGNRASLYSFPE

SEQ ID NO: 344152 - protein, 21 aa, Homo sapiens
  Native (PRAME_HUMAN)
HQDFWTVWSGNRASLYSFPEP

SEQ ID NO: 344153 - protein, 22 aa, Homo sapiens
  Native (PRAME_HUMAN)
HQDFWTVWSGNRASLYSFPEPE

SEQ ID NO: 344154 - protein, 23 aa, Homo sapiens
  Native (PRAME_HUMAN)
HQDFWTVWSGNRASLYSFPEPEA

SEQ ID NO: 344155 - protein, 24 aa, Homo sapiens
  Native (PRAME_HUMAN)
HQDFWTVWSGNRASLYSFPEPEAA

SEQ ID NO: 344156 - protein, 25 aa, Homo sapiens
  Native (PRAME_HUMAN)
HQDFWTVWSGNRASLYSFPEPEAAQ

SEQ ID NO: 344157 - protein, 14 aa, Homo sapiens
  Native (PRAME_HUMAN)
HSQTLKAMVQAWPF

SEQ ID NO: 344158 - protein, 15 aa, Homo sapiens
  Native (PRAME_HUMAN)
HSQTLKAMVQAWPFT

SEQ ID NO: 344159 - protein, 16 aa, Homo sapiens
  Native (PRAME_HUMAN)
HSQTLKAMVQAWPFTC

SEQ ID NO: 344160 - protein, 17 aa, Homo sapiens
  Native (PRAME_HUMAN)
HSQTLKAMVQAWPFTCL

SEQ ID NO: 344161 - protein, 18 aa, Homo sapiens
  Native (PRAME_HUMAN)
HSQTLKAMVQAWPFTCLP

SEQ ID NO: 344162 - protein, 19 aa, Homo sapiens
  Native (PRAME_HUMAN)
HSQTLKAMVQAWPFTCLPL

SEQ ID NO: 344163 - protein, 20 aa, Homo sapiens
  Native (PRAME_HUMAN)
HSQTLKAMVQAWPFTCLPLG

SEQ ID NO: 344164 - protein, 21 aa, Homo sapiens
  Native (PRAME_HUMAN)
HSQTLKAMVQAWPFTCLPLGV

SEQ ID NO: 344165 - protein, 22 aa, Homo sapiens
  Native (PRAME_HUMAN)
HSQTLKAMVQAWPFTCLPLGVL

SEQ ID NO: 344166 - protein, 23 aa, Homo sapiens
  Native (PRAME_HUMAN)
HSQTLKAMVQAWPFTCLPLGVLM

SEQ ID NO: 344167 - protein, 24 aa, Homo sapiens
  Native (PRAME_HUMAN)
HSQTLKAMVQAWPFTCLPLGVLMK

SEQ ID NO: 344168 - protein, 25 aa, Homo sapiens
  Native (PRAME_HUMAN)
HSQTLKAMVQAWPFTCLPLGVLMKG

SEQ ID NO: 344169 - protein, 13 aa, Homo sapiens
  Native (PRAME_HUMAN)
HVLYPVPLESYED

SEQ ID NO: 344170 - protein, 14 aa, Homo sapiens
  Native (PRAME_HUMAN)
HVLYPVPLESYEDI

SEQ ID NO: 344171 - protein, 15 aa, Homo sapiens
  Native (PRAME_HUMAN)
HVLYPVPLESYEDIH

SEQ ID NO: 344172 - protein, 16 aa, Homo sapiens
  Native (PRAME_HUMAN)
HVLYPVPLESYEDIHG

SEQ ID NO: 344173 - protein, 17 aa, Homo sapiens
  Native (PRAME_HUMAN)
HVLYPVPLESYEDIHGT

SEQ ID NO: 344174 - protein, 18 aa, Homo sapiens
  Native (PRAME_HUMAN)
HVLYPVPLESYEDIHGTL

SEQ ID NO: 344175 - protein, 19 aa, Homo sapiens
  Native (PRAME_HUMAN)
HVLYPVPLESYEDIHGTLH

SEQ ID NO: 344176 - protein, 20 aa, Homo sapiens
  Native (PRAME_HUMAN)
HVLYPVPLESYEDIHGTLHL

SEQ ID NO: 344177 - protein, 21 aa, Homo sapiens
  Native (PRAME_HUMAN)
HVLYPVPLESYEDIHGTLHLE

SEQ ID NO: 344178 - protein, 22 aa, Homo sapiens
  Native (PRAME_HUMAN)
HVLYPVPLESYEDIHGTLHLER

SEQ ID NO: 344179 - protein, 23 aa, Homo sapiens
  Native (PRAME_HUMAN)
HVLYPVPLESYEDIHGTLHLERL

SEQ ID NO: 344180 - protein, 24 aa, Homo sapiens
  Native (PRAME_HUMAN)
HVLYPVPLESYEDIHGTLHLERLA

SEQ ID NO: 344181 - protein, 25 aa, Homo sapiens
  Native (PRAME_HUMAN)
HVLYPVPLESYEDIHGTLHLERLAY

SEQ ID NO: 344182 - protein, 15 aa, Homo sapiens
  Native (PRAME_HUMAN)
HVMNPLETLSITNCR

SEQ ID NO: 344183 - protein, 16 aa, Homo sapiens
  Native (PRAME_HUMAN)
HVMNPLETLSITNCRL

SEQ ID NO: 344184 - protein, 17 aa, Homo sapiens
  Native (PRAME_HUMAN)
HVMNPLETLSITNCRLS

SEQ ID NO: 344185 - protein, 18 aa, Homo sapiens
  Native (PRAME_HUMAN)
HVMNPLETLSITNCRLSE

SEQ ID NO: 344186 - protein, 19 aa, Homo sapiens
  Native (PRAME_HUMAN)
HVMNPLETLSITNCRLSEG

SEQ ID NO: 344187 - protein, 20 aa, Homo sapiens
  Native (PRAME_HUMAN)
HVMNPLETLSITNCRLSEGD

SEQ ID NO: 344188 - protein, 21 aa, Homo sapiens
  Native (PRAME_HUMAN)
HVMNPLETLSITNCRLSEGDV

SEQ ID NO: 344189 - protein, 22 aa, Homo sapiens
  Native (PRAME_HUMAN)
HVMNPLETLSITNCRLSEGDVM

SEQ ID NO: 344190 - protein, 23 aa, Homo sapiens
  Native (PRAME_HUMAN)
HVMNPLETLSITNCRLSEGDVMH

SEQ ID NO: 344191 - protein, 24 aa, Homo sapiens
  Native (PRAME_HUMAN)
HVMNPLETLSITNCRLSEGDVMHL

SEQ ID NO: 344192 - protein, 25 aa, Homo sapiens
  Native (PRAME_HUMAN)
HVMNPLETLSITNCRLSEGDVMHLS

SEQ ID NO: 344193 - protein, 13 aa, Homo sapiens
  Native (PRAME_HUMAN)
IAALELLPRELFP

SEQ ID NO: 344194 - protein, 14 aa, Homo sapiens
  Native (PRAME_HUMAN)
IAALELLPRELFPP

SEQ ID NO: 344195 - protein, 15 aa, Homo sapiens
  Native (PRAME_HUMAN)
IAALELLPRELFPPL

SEQ ID NO: 344196 - protein, 16 aa, Homo sapiens
  Native (PRAME_HUMAN)
IAALELLPRELFPPLF

SEQ ID NO: 344197 - protein, 17 aa, Homo sapiens
  Native (PRAME_HUMAN)
IAALELLPRELFPPLFM

SEQ ID NO: 344198 - protein, 18 aa, Homo sapiens
  Native (PRAME_HUMAN)
IAALELLPRELFPPLFMA

SEQ ID NO: 344199 - protein, 19 aa, Homo sapiens
  Native (PRAME_HUMAN)
IAALELLPRELFPPLFMAA

SEQ ID NO: 344200 - protein, 20 aa, Homo sapiens
  Native (PRAME_HUMAN)
IAALELLPRELFPPLFMAAF

SEQ ID NO: 344201 - protein, 21 aa, Homo sapiens
  Native (PRAME_HUMAN)
IAALELLPRELFPPLFMAAFD

SEQ ID NO: 344202 - protein, 22 aa, Homo sapiens
  Native (PRAME_HUMAN)
IAALELLPRELFPPLFMAAFDG

SEQ ID NO: 344203 - protein, 23 aa, Homo sapiens
  Native (PRAME_HUMAN)
IAALELLPRELFPPLFMAAFDGR

SEQ ID NO: 344204 - protein, 24 aa, Homo sapiens
  Native (PRAME_HUMAN)
IAALELLPRELFPPLFMAAFDGRH

SEQ ID NO: 344205 - protein, 25 aa, Homo sapiens
  Native (PRAME_HUMAN)
IAALELLPRELFPPLFMAAFDGRHS

SEQ ID NO: 344206 - protein, 13 aa, Homo sapiens
  Native (PRAME_HUMAN)
IAQFTSQFLSLQC

SEQ ID NO: 344207 - protein, 14 aa, Homo sapiens
  Native (PRAME_HUMAN)
IAQFTSQFLSLQCL

SEQ ID NO: 344208 - protein, 15 aa, Homo sapiens
  Native (PRAME_HUMAN)
IAQFTSQFLSLQCLQ

SEQ ID NO: 344209 - protein, 16 aa, Homo sapiens
  Native (PRAME_HUMAN)
IAQFTSQFLSLQCLQA

SEQ ID NO: 344210 - protein, 17 aa, Homo sapiens
  Native (PRAME_HUMAN)
IAQFTSQFLSLQCLQAL

SEQ ID NO: 344211 - protein, 18 aa, Homo sapiens
  Native (PRAME_HUMAN)
IAQFTSQFLSLQCLQALY

SEQ ID NO: 344212 - protein, 19 aa, Homo sapiens
  Native (PRAME_HUMAN)
IAQFTSQFLSLQCLQALYV

SEQ ID NO: 344213 - protein, 20 aa, Homo sapiens
  Native (PRAME_HUMAN)
IAQFTSQFLSLQCLQALYVD

SEQ ID NO: 344214 - protein, 21 aa, Homo sapiens
  Native (PRAME_HUMAN)
IAQFTSQFLSLQCLQALYVDS

SEQ ID NO: 344215 - protein, 22 aa, Homo sapiens
  Native (PRAME_HUMAN)
IAQFTSQFLSLQCLQALYVDSL

SEQ ID NO: 344216 - protein, 23 aa, Homo sapiens
  Native (PRAME_HUMAN)
IAQFTSQFLSLQCLQALYVDSLF

SEQ ID NO: 344217 - protein, 24 aa, Homo sapiens
  Native (PRAME_HUMAN)
IAQFTSQFLSLQCLQALYVDSLFF

SEQ ID NO: 344218 - protein, 25 aa, Homo sapiens
  Native (PRAME_HUMAN)
IAQFTSQFLSLQCLQALYVDSLFFL

SEQ ID NO: 344219 - protein, 14 aa, Homo sapiens
  Native (PRAME_HUMAN)
IEDLEVTCTWKLPT

SEQ ID NO: 344220 - protein, 15 aa, Homo sapiens
  Native (PRAME_HUMAN)
IEDLEVTCTWKLPTL

SEQ ID NO: 344221 - protein, 16 aa, Homo sapiens
  Native (PRAME_HUMAN)
IEDLEVTCTWKLPTLA

SEQ ID NO: 344222 - protein, 17 aa, Homo sapiens
  Native (PRAME_HUMAN)
IEDLEVTCTWKLPTLAK

SEQ ID NO: 344223 - protein, 18 aa, Homo sapiens
  Native (PRAME_HUMAN)
IEDLEVTCTWKLPTLAKF

SEQ ID NO: 344224 - protein, 19 aa, Homo sapiens
  Native (PRAME_HUMAN)
IEDLEVTCTWKLPTLAKFS

SEQ ID NO: 344225 - protein, 20 aa, Homo sapiens
  Native (PRAME_HUMAN)
IEDLEVTCTWKLPTLAKFSP

SEQ ID NO: 344226 - protein, 21 aa, Homo sapiens
  Native (PRAME_HUMAN)
IEDLEVTCTWKLPTLAKFSPY

SEQ ID NO: 344227 - protein, 22 aa, Homo sapiens
  Native (PRAME_HUMAN)
IEDLEVTCTWKLPTLAKFSPYL

SEQ ID NO: 344228 - protein, 23 aa, Homo sapiens
  Native (PRAME_HUMAN)
IEDLEVTCTWKLPTLAKFSPYLG

SEQ ID NO: 344229 - protein, 24 aa, Homo sapiens
  Native (PRAME_HUMAN)
IEDLEVTCTWKLPTLAKFSPYLGQ

SEQ ID NO: 344230 - protein, 25 aa, Homo sapiens
  Native (PRAME_HUMAN)
IEDLEVTCTWKLPTLAKFSPYLGQM

SEQ ID NO: 344231 - protein, 13 aa, Homo sapiens
  Native (PRAME_HUMAN)
IEKVKRKKNVLRL

SEQ ID NO: 344232 - protein, 14 aa, Homo sapiens
  Native (PRAME_HUMAN)
IEKVKRKKNVLRLC

SEQ ID NO: 344233 - protein, 15 aa, Homo sapiens
  Native (PRAME_HUMAN)
IEKVKRKKNVLRLCC

SEQ ID NO: 344234 - protein, 16 aa, Homo sapiens
  Native (PRAME_HUMAN)
IEKVKRKKNVLRLCCK

SEQ ID NO: 344235 - protein, 17 aa, Homo sapiens
  Native (PRAME_HUMAN)
IEKVKRKKNVLRLCCKK

SEQ ID NO: 344236 - protein, 18 aa, Homo sapiens
  Native (PRAME_HUMAN)
IEKVKRKKNVLRLCCKKL

SEQ ID NO: 344237 - protein, 19 aa, Homo sapiens
  Native (PRAME_HUMAN)
IEKVKRKKNVLRLCCKKLK

SEQ ID NO: 344238 - protein, 20 aa, Homo sapiens
  Native (PRAME_HUMAN)
IEKVKRKKNVLRLCCKKLKI

SEQ ID NO: 344239 - protein, 21 aa, Homo sapiens
  Native (PRAME_HUMAN)
IEKVKRKKNVLRLCCKKLKIF

SEQ ID NO: 344240 - protein, 22 aa, Homo sapiens
  Native (PRAME_HUMAN)
IEKVKRKKNVLRLCCKKLKIFA

SEQ ID NO: 344241 - protein, 23 aa, Homo sapiens
  Native (PRAME_HUMAN)
IEKVKRKKNVLRLCCKKLKIFAM

SEQ ID NO: 344242 - protein, 24 aa, Homo sapiens
  Native (PRAME_HUMAN)
IEKVKRKKNVLRLCCKKLKIFAMP

SEQ ID NO: 344243 - protein, 25 aa, Homo sapiens
  Native (PRAME_HUMAN)
IEKVKRKKNVLRLCCKKLKIFAMPM

SEQ ID NO: 344244 - protein, 13 aa, Homo sapiens
  Native (PRAME_HUMAN)
IFAMPMQDIKMIL

SEQ ID NO: 344245 - protein, 14 aa, Homo sapiens
  Native (PRAME_HUMAN)
IFAMPMQDIKMILK

SEQ ID NO: 344246 - protein, 15 aa, Homo sapiens
  Native (PRAME_HUMAN)
IFAMPMQDIKMILKM

SEQ ID NO: 344247 - protein, 16 aa, Homo sapiens
  Native (PRAME_HUMAN)
IFAMPMQDIKMILKMV

SEQ ID NO: 344248 - protein, 17 aa, Homo sapiens
  Native (PRAME_HUMAN)
IFAMPMQDIKMILKMVQ

SEQ ID NO: 344249 - protein, 18 aa, Homo sapiens
  Native (PRAME_HUMAN)
IFAMPMQDIKMILKMVQL

SEQ ID NO: 344250 - protein, 19 aa, Homo sapiens
  Native (PRAME_HUMAN)
IFAMPMQDIKMILKMVQLD

SEQ ID NO: 344251 - protein, 20 aa, Homo sapiens
  Native (PRAME_HUMAN)
IFAMPMQDIKMILKMVQLDS

SEQ ID NO: 344252 - protein, 21 aa, Homo sapiens
  Native (PRAME_HUMAN)
IFAMPMQDIKMILKMVQLDSI

SEQ ID NO: 344253 - protein, 22 aa, Homo sapiens
  Native (PRAME_HUMAN)
IFAMPMQDIKMILKMVQLDSIE

SEQ ID NO: 344254 - protein, 23 aa, Homo sapiens
  Native (PRAME_HUMAN)
IFAMPMQDIKMILKMVQLDSIED

SEQ ID NO: 344255 - protein, 24 aa, Homo sapiens
  Native (PRAME_HUMAN)
IFAMPMQDIKMILKMVQLDSIEDL

SEQ ID NO: 344256 - protein, 25 aa, Homo sapiens
  Native (PRAME_HUMAN)
IFAMPMQDIKMILKMVQLDSIEDLE

SEQ ID NO: 344257 - protein, 13 aa, Homo sapiens
  Native (PRAME_HUMAN)
IGLSNLTHVLYPV

SEQ ID NO: 344258 - protein, 14 aa, Homo sapiens
  Native (PRAME_HUMAN)
IGLSNLTHVLYPVP

SEQ ID NO: 344259 - protein, 15 aa, Homo sapiens
  Native (PRAME_HUMAN)
IGLSNLTHVLYPVPL

SEQ ID NO: 344260 - protein, 16 aa, Homo sapiens
  Native (PRAME_HUMAN)
IGLSNLTHVLYPVPLE

SEQ ID NO: 344261 - protein, 17 aa, Homo sapiens
  Native (PRAME_HUMAN)
IGLSNLTHVLYPVPLES

SEQ ID NO: 344262 - protein, 18 aa, Homo sapiens
  Native (PRAME_HUMAN)
IGLSNLTHVLYPVPLESY

SEQ ID NO: 344263 - protein, 19 aa, Homo sapiens
  Native (PRAME_HUMAN)
IGLSNLTHVLYPVPLESYE

SEQ ID NO: 344264 - protein, 20 aa, Homo sapiens
  Native (PRAME_HUMAN)
IGLSNLTHVLYPVPLESYED

SEQ ID NO: 344265 - protein, 21 aa, Homo sapiens
  Native (PRAME_HUMAN)
IGLSNLTHVLYPVPLESYEDI

SEQ ID NO: 344266 - protein, 22 aa, Homo sapiens
  Native (PRAME_HUMAN)
IGLSNLTHVLYPVPLESYEDIH

SEQ ID NO: 344267 - protein, 23 aa, Homo sapiens
  Native (PRAME_HUMAN)
IGLSNLTHVLYPVPLESYEDIHG

SEQ ID NO: 344268 - protein, 24 aa, Homo sapiens
  Native (PRAME_HUMAN)
IGLSNLTHVLYPVPLESYEDIHGT

SEQ ID NO: 344269 - protein, 25 aa, Homo sapiens
  Native (PRAME_HUMAN)
IGLSNLTHVLYPVPLESYEDIHGTL

SEQ ID NO: 344270 - protein, 20 aa, Homo sapiens
  Native (PRAME_HUMAN)
IHASSYISPEKEEQYIAQFT

SEQ ID NO: 344271 - protein, 23 aa, Homo sapiens
  Native (PRAME_HUMAN)
IHASSYISPEKEEQYIAQFTSQF

SEQ ID NO: 344272 - protein, 24 aa, Homo sapiens
  Native (PRAME_HUMAN)
IHASSYISPEKEEQYIAQFTSQFL

SEQ ID NO: 344273 - protein, 25 aa, Homo sapiens
  Native (PRAME_HUMAN)
IHASSYISPEKEEQYIAQFTSQFLS

SEQ ID NO: 344274 - protein, 13 aa, Homo sapiens
  Native (PRAME_HUMAN)
IHGTLHLERLAYL

SEQ ID NO: 344275 - protein, 14 aa, Homo sapiens
  Native (PRAME_HUMAN)
IHGTLHLERLAYLH

SEQ ID NO: 344276 - protein, 15 aa, Homo sapiens
  Native (PRAME_HUMAN)
IHGTLHLERLAYLHA

SEQ ID NO: 344277 - protein, 16 aa, Homo sapiens
  Native (PRAME_HUMAN)
IHGTLHLERLAYLHAR

SEQ ID NO: 344278 - protein, 17 aa, Homo sapiens
  Native (PRAME_HUMAN)
IHGTLHLERLAYLHARL

SEQ ID NO: 344279 - protein, 18 aa, Homo sapiens
  Native (PRAME_HUMAN)
IHGTLHLERLAYLHARLR

SEQ ID NO: 344280 - protein, 19 aa, Homo sapiens
  Native (PRAME_HUMAN)
IHGTLHLERLAYLHARLRE

SEQ ID NO: 344281 - protein, 20 aa, Homo sapiens
  Native (PRAME_HUMAN)
IHGTLHLERLAYLHARLREL

SEQ ID NO: 344282 - protein, 21 aa, Homo sapiens
  Native (PRAME_HUMAN)
IHGTLHLERLAYLHARLRELL

SEQ ID NO: 344283 - protein, 22 aa, Homo sapiens
  Native (PRAME_HUMAN)
IHGTLHLERLAYLHARLRELLC

SEQ ID NO: 344284 - protein, 23 aa, Homo sapiens
  Native (PRAME_HUMAN)
IHGTLHLERLAYLHARLRELLCE

SEQ ID NO: 344285 - protein, 24 aa, Homo sapiens
  Native (PRAME_HUMAN)
IHGTLHLERLAYLHARLRELLCEL

SEQ ID NO: 344286 - protein, 25 aa, Homo sapiens
  Native (PRAME_HUMAN)
IHGTLHLERLAYLHARLRELLCELG

SEQ ID NO: 344287 - protein, 13 aa, Homo sapiens
  Native (PRAME_HUMAN)
IKMILKMVQLDSI

SEQ ID NO: 344288 - protein, 14 aa, Homo sapiens
  Native (PRAME_HUMAN)
IKMILKMVQLDSIE

SEQ ID NO: 344289 - protein, 15 aa, Homo sapiens
  Native (PRAME_HUMAN)
IKMILKMVQLDSIED

SEQ ID NO: 344290 - protein, 16 aa, Homo sapiens
  Native (PRAME_HUMAN)
IKMILKMVQLDSIEDL

SEQ ID NO: 344291 - protein, 17 aa, Homo sapiens
  Native (PRAME_HUMAN)
IKMILKMVQLDSIEDLE

SEQ ID NO: 344292 - protein, 18 aa, Homo sapiens
  Native (PRAME_HUMAN)
IKMILKMVQLDSIEDLEV

SEQ ID NO: 344293 - protein, 19 aa, Homo sapiens
  Native (PRAME_HUMAN)
IKMILKMVQLDSIEDLEVT

SEQ ID NO: 344294 - protein, 20 aa, Homo sapiens
  Native (PRAME_HUMAN)
IKMILKMVQLDSIEDLEVTC

SEQ ID NO: 344295 - protein, 21 aa, Homo sapiens
  Native (PRAME_HUMAN)
IKMILKMVQLDSIEDLEVTCT

SEQ ID NO: 344296 - protein, 22 aa, Homo sapiens
  Native (PRAME_HUMAN)
IKMILKMVQLDSIEDLEVTCTW

SEQ ID NO: 344297 - protein, 23 aa, Homo sapiens
  Native (PRAME_HUMAN)
IKMILKMVQLDSIEDLEVTCTWK

SEQ ID NO: 344298 - protein, 24 aa, Homo sapiens
  Native (PRAME_HUMAN)
IKMILKMVQLDSIEDLEVTCTWKL

SEQ ID NO: 344299 - protein, 25 aa, Homo sapiens
  Native (PRAME_HUMAN)
IKMILKMVQLDSIEDLEVTCTWKLP

SEQ ID NO: 344300 - protein, 13 aa, Homo sapiens
  Native (PRAME_HUMAN)
ILKMVQLDSIEDL

SEQ ID NO: 344301 - protein, 14 aa, Homo sapiens
  Native (PRAME_HUMAN)
ILKMVQLDSIEDLE

SEQ ID NO: 344302 - protein, 15 aa, Homo sapiens
  Native (PRAME_HUMAN)
ILKMVQLDSIEDLEV

SEQ ID NO: 344303 - protein, 16 aa, Homo sapiens
  Native (PRAME_HUMAN)
ILKMVQLDSIEDLEVT

SEQ ID NO: 344304 - protein, 17 aa, Homo sapiens
  Native (PRAME_HUMAN)
ILKMVQLDSIEDLEVTC

SEQ ID NO: 344305 - protein, 18 aa, Homo sapiens
  Native (PRAME_HUMAN)
ILKMVQLDSIEDLEVTCT

SEQ ID NO: 344306 - protein, 19 aa, Homo sapiens
  Native (PRAME_HUMAN)
ILKMVQLDSIEDLEVTCTW

SEQ ID NO: 344307 - protein, 20 aa, Homo sapiens
  Native (PRAME_HUMAN)
ILKMVQLDSIEDLEVTCTWK

SEQ ID NO: 344308 - protein, 21 aa, Homo sapiens
  Native (PRAME_HUMAN)
ILKMVQLDSIEDLEVTCTWKL

SEQ ID NO: 344309 - protein, 22 aa, Homo sapiens
  Native (PRAME_HUMAN)
ILKMVQLDSIEDLEVTCTWKLP

SEQ ID NO: 344310 - protein, 23 aa, Homo sapiens
  Native (PRAME_HUMAN)
ILKMVQLDSIEDLEVTCTWKLPT

SEQ ID NO: 344311 - protein, 24 aa, Homo sapiens
  Native (PRAME_HUMAN)
ILKMVQLDSIEDLEVTCTWKLPTL

SEQ ID NO: 344312 - protein, 25 aa, Homo sapiens
  Native (PRAME_HUMAN)
ILKMVQLDSIEDLEVTCTWKLPTLA

SEQ ID NO: 344313 - protein, 13 aa, Homo sapiens
  Native (PRAME_HUMAN)
INLRRLLLSHIHA

SEQ ID NO: 344314 - protein, 14 aa, Homo sapiens
  Native (PRAME_HUMAN)
INLRRLLLSHIHAS

SEQ ID NO: 344315 - protein, 15 aa, Homo sapiens
  Native (PRAME_HUMAN)
INLRRLLLSHIHASS

SEQ ID NO: 344316 - protein, 16 aa, Homo sapiens
  Native (PRAME_HUMAN)
INLRRLLLSHIHASSY

SEQ ID NO: 344317 - protein, 17 aa, Homo sapiens
  Native (PRAME_HUMAN)
INLRRLLLSHIHASSYI

SEQ ID NO: 344318 - protein, 18 aa, Homo sapiens
  Native (PRAME_HUMAN)
INLRRLLLSHIHASSYIS

SEQ ID NO: 344319 - protein, 19 aa, Homo sapiens
  Native (PRAME_HUMAN)
INLRRLLLSHIHASSYISP

SEQ ID NO: 344320 - protein, 20 aa, Homo sapiens
  Native (PRAME_HUMAN)
INLRRLLLSHIHASSYISPE

SEQ ID NO: 344321 - protein, 21 aa, Homo sapiens
  Native (PRAME_HUMAN)
INLRRLLLSHIHASSYISPEK

SEQ ID NO: 344322 - protein, 22 aa, Homo sapiens
  Native (PRAME_HUMAN)
INLRRLLLSHIHASSYISPEKE

SEQ ID NO: 344323 - protein, 23 aa, Homo sapiens
  Native (PRAME_HUMAN)
INLRRLLLSHIHASSYISPEKEE

SEQ ID NO: 344324 - protein, 24 aa, Homo sapiens
  Native (PRAME_HUMAN)
INLRRLLLSHIHASSYISPEKEEQ

SEQ ID NO: 344325 - protein, 25 aa, Homo sapiens
  Native (PRAME_HUMAN)
INLRRLLLSHIHASSYISPEKEEQY

SEQ ID NO: 344326 - protein, 13 aa, Homo sapiens
  Native (PRAME_HUMAN)
IPVEVLVDLFLKE

SEQ ID NO: 344327 - protein, 14 aa, Homo sapiens
  Native (PRAME_HUMAN)
IPVEVLVDLFLKEG

SEQ ID NO: 344328 - protein, 15 aa, Homo sapiens
  Native (PRAME_HUMAN)
IPVEVLVDLFLKEGA

SEQ ID NO: 344329 - protein, 16 aa, Homo sapiens
  Native (PRAME_HUMAN)
IPVEVLVDLFLKEGAC

SEQ ID NO: 344330 - protein, 17 aa, Homo sapiens
  Native (PRAME_HUMAN)
IPVEVLVDLFLKEGACD

SEQ ID NO: 344331 - protein, 18 aa, Homo sapiens
  Native (PRAME_HUMAN)
IPVEVLVDLFLKEGACDE

SEQ ID NO: 344332 - protein, 19 aa, Homo sapiens
  Native (PRAME_HUMAN)
IPVEVLVDLFLKEGACDEL

SEQ ID NO: 344333 - protein, 20 aa, Homo sapiens
  Native (PRAME_HUMAN)
IPVEVLVDLFLKEGACDELF

SEQ ID NO: 344334 - protein, 21 aa, Homo sapiens
  Native (PRAME_HUMAN)
IPVEVLVDLFLKEGACDELFS

SEQ ID NO: 344335 - protein, 22 aa, Homo sapiens
  Native (PRAME_HUMAN)
IPVEVLVDLFLKEGACDELFSY

SEQ ID NO: 344336 - protein, 23 aa, Homo sapiens
  Native (PRAME_HUMAN)
IPVEVLVDLFLKEGACDELFSYL

SEQ ID NO: 344337 - protein, 24 aa, Homo sapiens
  Native (PRAME_HUMAN)
IPVEVLVDLFLKEGACDELFSYLI

SEQ ID NO: 344338 - protein, 25 aa, Homo sapiens
  Native (PRAME_HUMAN)
IPVEVLVDLFLKEGACDELFSYLIE

SEQ ID NO: 344339 - protein, 13 aa, Homo sapiens
  Native (PRAME_HUMAN)
IQSRYISMSVWTS

SEQ ID NO: 344340 - protein, 14 aa, Homo sapiens
  Native (PRAME_HUMAN)
IQSRYISMSVWTSP

SEQ ID NO: 344341 - protein, 15 aa, Homo sapiens
  Native (PRAME_HUMAN)
IQSRYISMSVWTSPR

SEQ ID NO: 344342 - protein, 16 aa, Homo sapiens
  Native (PRAME_HUMAN)
IQSRYISMSVWTSPRR

SEQ ID NO: 344343 - protein, 17 aa, Homo sapiens
  Native (PRAME_HUMAN)
IQSRYISMSVWTSPRRL

SEQ ID NO: 344344 - protein, 18 aa, Homo sapiens
  Native (PRAME_HUMAN)
IQSRYISMSVWTSPRRLV

SEQ ID NO: 344345 - protein, 19 aa, Homo sapiens
  Native (PRAME_HUMAN)
IQSRYISMSVWTSPRRLVE

SEQ ID NO: 344346 - protein, 20 aa, Homo sapiens
  Native (PRAME_HUMAN)
IQSRYISMSVWTSPRRLVEL

SEQ ID NO: 344347 - protein, 21 aa, Homo sapiens
  Native (PRAME_HUMAN)
IQSRYISMSVWTSPRRLVELA

SEQ ID NO: 344348 - protein, 22 aa, Homo sapiens
  Native (PRAME_HUMAN)
IQSRYISMSVWTSPRRLVELAG

SEQ ID NO: 344349 - protein, 23 aa, Homo sapiens
  Native (PRAME_HUMAN)
IQSRYISMSVWTSPRRLVELAGQ

SEQ ID NO: 344350 - protein, 24 aa, Homo sapiens
  Native (PRAME_HUMAN)
IQSRYISMSVWTSPRRLVELAGQS

SEQ ID NO: 344351 - protein, 25 aa, Homo sapiens
  Native (PRAME_HUMAN)
IQSRYISMSVWTSPRRLVELAGQSL

SEQ ID NO: 344352 - protein, 13 aa, Homo sapiens
  Native (PRAME_HUMAN)
ISALQSLLQHLIG

SEQ ID NO: 344353 - protein, 14 aa, Homo sapiens
  Native (PRAME_HUMAN)
ISALQSLLQHLIGL

SEQ ID NO: 344354 - protein, 15 aa, Homo sapiens
  Native (PRAME_HUMAN)
ISALQSLLQHLIGLS

SEQ ID NO: 344355 - protein, 16 aa, Homo sapiens
  Native (PRAME_HUMAN)
ISALQSLLQHLIGLSN

SEQ ID NO: 344356 - protein, 17 aa, Homo sapiens
  Native (PRAME_HUMAN)
ISALQSLLQHLIGLSNL

SEQ ID NO: 344357 - protein, 18 aa, Homo sapiens
  Native (PRAME_HUMAN)
ISALQSLLQHLIGLSNLT

SEQ ID NO: 344358 - protein, 19 aa, Homo sapiens
  Native (PRAME_HUMAN)
ISALQSLLQHLIGLSNLTH

SEQ ID NO: 344359 - protein, 20 aa, Homo sapiens
  Native (PRAME_HUMAN)
ISALQSLLQHLIGLSNLTHV

SEQ ID NO: 344360 - protein, 21 aa, Homo sapiens
  Native (PRAME_HUMAN)
ISALQSLLQHLIGLSNLTHVL

SEQ ID NO: 344361 - protein, 22 aa, Homo sapiens
  Native (PRAME_HUMAN)
ISALQSLLQHLIGLSNLTHVLY

SEQ ID NO: 344362 - protein, 23 aa, Homo sapiens
  Native (PRAME_HUMAN)
ISALQSLLQHLIGLSNLTHVLYP

SEQ ID NO: 344363 - protein, 24 aa, Homo sapiens
  Native (PRAME_HUMAN)
ISALQSLLQHLIGLSNLTHVLYPV

SEQ ID NO: 344364 - protein, 25 aa, Homo sapiens
  Native (PRAME_HUMAN)
ISALQSLLQHLIGLSNLTHVLYPVP

SEQ ID NO: 344365 - protein, 13 aa, Homo sapiens
  Native (PRAME_HUMAN)
ISISALQSLLQHL

SEQ ID NO: 344366 - protein, 14 aa, Homo sapiens
  Native (PRAME_HUMAN)
ISISALQSLLQHLI

SEQ ID NO: 344367 - protein, 15 aa, Homo sapiens
  Native (PRAME_HUMAN)
ISISALQSLLQHLIG

SEQ ID NO: 344368 - protein, 16 aa, Homo sapiens
  Native (PRAME_HUMAN)
ISISALQSLLQHLIGL

SEQ ID NO: 344369 - protein, 17 aa, Homo sapiens
  Native (PRAME_HUMAN)
ISISALQSLLQHLIGLS

SEQ ID NO: 344370 - protein, 18 aa, Homo sapiens
  Native (PRAME_HUMAN)
ISISALQSLLQHLIGLSN

SEQ ID NO: 344371 - protein, 19 aa, Homo sapiens
  Native (PRAME_HUMAN)
ISISALQSLLQHLIGLSNL

SEQ ID NO: 344372 - protein, 20 aa, Homo sapiens
  Native (PRAME_HUMAN)
ISISALQSLLQHLIGLSNLT

SEQ ID NO: 344373 - protein, 21 aa, Homo sapiens
  Native (PRAME_HUMAN)
ISISALQSLLQHLIGLSNLTH

SEQ ID NO: 344374 - protein, 22 aa, Homo sapiens
  Native (PRAME_HUMAN)
ISISALQSLLQHLIGLSNLTHV

SEQ ID NO: 344375 - protein, 23 aa, Homo sapiens
  Native (PRAME_HUMAN)
ISISALQSLLQHLIGLSNLTHVL

SEQ ID NO: 344376 - protein, 24 aa, Homo sapiens
  Native (PRAME_HUMAN)
ISISALQSLLQHLIGLSNLTHVLY

SEQ ID NO: 344377 - protein, 25 aa, Homo sapiens
  Native (PRAME_HUMAN)
ISISALQSLLQHLIGLSNLTHVLYP

SEQ ID NO: 344378 - protein, 13 aa, Homo sapiens
  Native (PRAME_HUMAN)
ISMSVWTSPRRLV

SEQ ID NO: 344379 - protein, 14 aa, Homo sapiens
  Native (PRAME_HUMAN)
ISMSVWTSPRRLVE

SEQ ID NO: 344380 - protein, 15 aa, Homo sapiens
  Native (PRAME_HUMAN)
ISMSVWTSPRRLVEL

SEQ ID NO: 344381 - protein, 16 aa, Homo sapiens
  Native (PRAME_HUMAN)
ISMSVWTSPRRLVELA

SEQ ID NO: 344382 - protein, 17 aa, Homo sapiens
  Native (PRAME_HUMAN)
ISMSVWTSPRRLVELAG

SEQ ID NO: 344383 - protein, 18 aa, Homo sapiens
  Native (PRAME_HUMAN)
ISMSVWTSPRRLVELAGQ

SEQ ID NO: 344384 - protein, 19 aa, Homo sapiens
  Native (PRAME_HUMAN)
ISMSVWTSPRRLVELAGQS

SEQ ID NO: 344385 - protein, 20 aa, Homo sapiens
  Native (PRAME_HUMAN)
ISMSVWTSPRRLVELAGQSL

SEQ ID NO: 344386 - protein, 21 aa, Homo sapiens
  Native (PRAME_HUMAN)
ISMSVWTSPRRLVELAGQSLL

SEQ ID NO: 344387 - protein, 22 aa, Homo sapiens
  Native (PRAME_HUMAN)
ISMSVWTSPRRLVELAGQSLLK

SEQ ID NO: 344388 - protein, 23 aa, Homo sapiens
  Native (PRAME_HUMAN)
ISMSVWTSPRRLVELAGQSLLKD

SEQ ID NO: 344389 - protein, 24 aa, Homo sapiens
  Native (PRAME_HUMAN)
ISMSVWTSPRRLVELAGQSLLKDE

SEQ ID NO: 344390 - protein, 25 aa, Homo sapiens
  Native (PRAME_HUMAN)
ISMSVWTSPRRLVELAGQSLLKDEA

SEQ ID NO: 344391 - protein, 17 aa, Homo sapiens
  Native (PRAME_HUMAN)
ISPEKEEQYIAQFTSQF

SEQ ID NO: 344392 - protein, 18 aa, Homo sapiens
  Native (PRAME_HUMAN)
ISPEKEEQYIAQFTSQFL

SEQ ID NO: 344393 - protein, 19 aa, Homo sapiens
  Native (PRAME_HUMAN)
ISPEKEEQYIAQFTSQFLS

SEQ ID NO: 344394 - protein, 20 aa, Homo sapiens
  Native (PRAME_HUMAN)
ISPEKEEQYIAQFTSQFLSL

SEQ ID NO: 344395 - protein, 21 aa, Homo sapiens
  Native (PRAME_HUMAN)
ISPEKEEQYIAQFTSQFLSLQ

SEQ ID NO: 344396 - protein, 22 aa, Homo sapiens
  Native (PRAME_HUMAN)
ISPEKEEQYIAQFTSQFLSLQC

SEQ ID NO: 344397 - protein, 23 aa, Homo sapiens
  Native (PRAME_HUMAN)
ISPEKEEQYIAQFTSQFLSLQCL

SEQ ID NO: 344398 - protein, 24 aa, Homo sapiens
  Native (PRAME_HUMAN)
ISPEKEEQYIAQFTSQFLSLQCLQ

SEQ ID NO: 344399 - protein, 25 aa, Homo sapiens
  Native (PRAME_HUMAN)
ISPEKEEQYIAQFTSQFLSLQCLQA

SEQ ID NO: 344400 - protein, 13 aa, Homo sapiens
  Native (PRAME_HUMAN)
ITDDQLLALLPSL

SEQ ID NO: 344401 - protein, 14 aa, Homo sapiens
  Native (PRAME_HUMAN)
ITDDQLLALLPSLS

SEQ ID NO: 344402 - protein, 15 aa, Homo sapiens
  Native (PRAME_HUMAN)
ITDDQLLALLPSLSH

SEQ ID NO: 344403 - protein, 16 aa, Homo sapiens
  Native (PRAME_HUMAN)
ITDDQLLALLPSLSHC

SEQ ID NO: 344404 - protein, 17 aa, Homo sapiens
  Native (PRAME_HUMAN)
ITDDQLLALLPSLSHCS

SEQ ID NO: 344405 - protein, 18 aa, Homo sapiens
  Native (PRAME_HUMAN)
ITDDQLLALLPSLSHCSQ

SEQ ID NO: 344406 - protein, 19 aa, Homo sapiens
  Native (PRAME_HUMAN)
ITDDQLLALLPSLSHCSQL

SEQ ID NO: 344407 - protein, 20 aa, Homo sapiens
  Native (PRAME_HUMAN)
ITDDQLLALLPSLSHCSQLT

SEQ ID NO: 344408 - protein, 21 aa, Homo sapiens
  Native (PRAME_HUMAN)
ITDDQLLALLPSLSHCSQLTT

SEQ ID NO: 344409 - protein, 22 aa, Homo sapiens
  Native (PRAME_HUMAN)
ITDDQLLALLPSLSHCSQLTTL

SEQ ID NO: 344410 - protein, 23 aa, Homo sapiens
  Native (PRAME_HUMAN)
ITDDQLLALLPSLSHCSQLTTLS

SEQ ID NO: 344411 - protein, 24 aa, Homo sapiens
  Native (PRAME_HUMAN)
ITDDQLLALLPSLSHCSQLTTLSF

SEQ ID NO: 344412 - protein, 25 aa, Homo sapiens
  Native (PRAME_HUMAN)
ITDDQLLALLPSLSHCSQLTTLSFY

SEQ ID NO: 344413 - protein, 15 aa, Homo sapiens
  Native (PRAME_HUMAN)
ITNCRLSEGDVMHLS

SEQ ID NO: 344414 - protein, 20 aa, Homo sapiens
  Native (PRAME_HUMAN)
ITNCRLSEGDVMHLSQSPSV

SEQ ID NO: 344415 - protein, 21 aa, Homo sapiens
  Native (PRAME_HUMAN)
ITNCRLSEGDVMHLSQSPSVS

SEQ ID NO: 344416 - protein, 22 aa, Homo sapiens
  Native (PRAME_HUMAN)
ITNCRLSEGDVMHLSQSPSVSQ

SEQ ID NO: 344417 - protein, 23 aa, Homo sapiens
  Native (PRAME_HUMAN)
ITNCRLSEGDVMHLSQSPSVSQL

SEQ ID NO: 344418 - protein, 24 aa, Homo sapiens
  Native (PRAME_HUMAN)
ITNCRLSEGDVMHLSQSPSVSQLS

SEQ ID NO: 344419 - protein, 25 aa, Homo sapiens
  Native (PRAME_HUMAN)
ITNCRLSEGDVMHLSQSPSVSQLSV

SEQ ID NO: 344420 - protein, 13 aa, Homo sapiens
  Native (PRAME_HUMAN)
KAMVQAWPFTCLP

SEQ ID NO: 344421 - protein, 14 aa, Homo sapiens
  Native (PRAME_HUMAN)
KAMVQAWPFTCLPL

SEQ ID NO: 344422 - protein, 15 aa, Homo sapiens
  Native (PRAME_HUMAN)
KAMVQAWPFTCLPLG

SEQ ID NO: 344423 - protein, 16 aa, Homo sapiens
  Native (PRAME_HUMAN)
KAMVQAWPFTCLPLGV

SEQ ID NO: 344424 - protein, 17 aa, Homo sapiens
  Native (PRAME_HUMAN)
KAMVQAWPFTCLPLGVL

SEQ ID NO: 344425 - protein, 18 aa, Homo sapiens
  Native (PRAME_HUMAN)
KAMVQAWPFTCLPLGVLM

SEQ ID NO: 344426 - protein, 19 aa, Homo sapiens
  Native (PRAME_HUMAN)
KAMVQAWPFTCLPLGVLMK

SEQ ID NO: 344427 - protein, 20 aa, Homo sapiens
  Native (PRAME_HUMAN)
KAMVQAWPFTCLPLGVLMKG

SEQ ID NO: 344428 - protein, 21 aa, Homo sapiens
  Native (PRAME_HUMAN)
KAMVQAWPFTCLPLGVLMKGQ

SEQ ID NO: 344429 - protein, 22 aa, Homo sapiens
  Native (PRAME_HUMAN)
KAMVQAWPFTCLPLGVLMKGQH

SEQ ID NO: 344430 - protein, 23 aa, Homo sapiens
  Native (PRAME_HUMAN)
KAMVQAWPFTCLPLGVLMKGQHL

SEQ ID NO: 344431 - protein, 24 aa, Homo sapiens
  Native (PRAME_HUMAN)
KAMVQAWPFTCLPLGVLMKGQHLH

SEQ ID NO: 344432 - protein, 25 aa, Homo sapiens
  Native (PRAME_HUMAN)
KAMVQAWPFTCLPLGVLMKGQHLHL

SEQ ID NO: 344433 - protein, 13 aa, Homo sapiens
  Native (PRAME_HUMAN)
KAVLDGLDVLLAQ

SEQ ID NO: 344434 - protein, 14 aa, Homo sapiens
  Native (PRAME_HUMAN)
KAVLDGLDVLLAQE

SEQ ID NO: 344435 - protein, 15 aa, Homo sapiens
  Native (PRAME_HUMAN)
KAVLDGLDVLLAQEV

SEQ ID NO: 344436 - protein, 16 aa, Homo sapiens
  Native (PRAME_HUMAN)
KAVLDGLDVLLAQEVR

SEQ ID NO: 344437 - protein, 17 aa, Homo sapiens
  Native (PRAME_HUMAN)
KAVLDGLDVLLAQEVRP

SEQ ID NO: 344438 - protein, 18 aa, Homo sapiens
  Native (PRAME_HUMAN)
KAVLDGLDVLLAQEVRPR

SEQ ID NO: 344439 - protein, 19 aa, Homo sapiens
  Native (PRAME_HUMAN)
KAVLDGLDVLLAQEVRPRR

SEQ ID NO: 344440 - protein, 20 aa, Homo sapiens
  Native (PRAME_HUMAN)
KAVLDGLDVLLAQEVRPRRW

SEQ ID NO: 344441 - protein, 21 aa, Homo sapiens
  Native (PRAME_HUMAN)
KAVLDGLDVLLAQEVRPRRWK

SEQ ID NO: 344442 - protein, 22 aa, Homo sapiens
  Native (PRAME_HUMAN)
KAVLDGLDVLLAQEVRPRRWKL

SEQ ID NO: 344443 - protein, 23 aa, Homo sapiens
  Native (PRAME_HUMAN)
KAVLDGLDVLLAQEVRPRRWKLQ

SEQ ID NO: 344444 - protein, 24 aa, Homo sapiens
  Native (PRAME_HUMAN)
KAVLDGLDVLLAQEVRPRRWKLQV

SEQ ID NO: 344445 - protein, 25 aa, Homo sapiens
  Native (PRAME_HUMAN)
KAVLDGLDVLLAQEVRPRRWKLQVL

SEQ ID NO: 344446 - protein, 13 aa, Homo sapiens
  Native (PRAME_HUMAN)
KDEALAIAALELL

SEQ ID NO: 344447 - protein, 14 aa, Homo sapiens
  Native (PRAME_HUMAN)
KDEALAIAALELLP

SEQ ID NO: 344448 - protein, 15 aa, Homo sapiens
  Native (PRAME_HUMAN)
KDEALAIAALELLPR

SEQ ID NO: 344449 - protein, 16 aa, Homo sapiens
  Native (PRAME_HUMAN)
KDEALAIAALELLPRE

SEQ ID NO: 344450 - protein, 17 aa, Homo sapiens
  Native (PRAME_HUMAN)
KDEALAIAALELLPREL

SEQ ID NO: 344451 - protein, 18 aa, Homo sapiens
  Native (PRAME_HUMAN)
KDEALAIAALELLPRELF

SEQ ID NO: 344452 - protein, 19 aa, Homo sapiens
  Native (PRAME_HUMAN)
KDEALAIAALELLPRELFP

SEQ ID NO: 344453 - protein, 20 aa, Homo sapiens
  Native (PRAME_HUMAN)
KDEALAIAALELLPRELFPP

SEQ ID NO: 344454 - protein, 21 aa, Homo sapiens
  Native (PRAME_HUMAN)
KDEALAIAALELLPRELFPPL

SEQ ID NO: 344455 - protein, 22 aa, Homo sapiens
  Native (PRAME_HUMAN)
KDEALAIAALELLPRELFPPLF

SEQ ID NO: 344456 - protein, 23 aa, Homo sapiens
  Native (PRAME_HUMAN)
KDEALAIAALELLPRELFPPLFM

SEQ ID NO: 344457 - protein, 24 aa, Homo sapiens
  Native (PRAME_HUMAN)
KDEALAIAALELLPRELFPPLFMA

SEQ ID NO: 344458 - protein, 25 aa, Homo sapiens
  Native (PRAME_HUMAN)
KDEALAIAALELLPRELFPPLFMAA

SEQ ID NO: 344459 - protein, 14 aa, Homo sapiens
  Native (PRAME_HUMAN)
KEEQYIAQFTSQFL

SEQ ID NO: 344460 - protein, 15 aa, Homo sapiens
  Native (PRAME_HUMAN)
KEEQYIAQFTSQFLS

SEQ ID NO: 344461 - protein, 16 aa, Homo sapiens
  Native (PRAME_HUMAN)
KEEQYIAQFTSQFLSL

SEQ ID NO: 344462 - protein, 17 aa, Homo sapiens
  Native (PRAME_HUMAN)
KEEQYIAQFTSQFLSLQ

SEQ ID NO: 344463 - protein, 18 aa, Homo sapiens
  Native (PRAME_HUMAN)
KEEQYIAQFTSQFLSLQC

SEQ ID NO: 344464 - protein, 19 aa, Homo sapiens
  Native (PRAME_HUMAN)
KEEQYIAQFTSQFLSLQCL

SEQ ID NO: 344465 - protein, 20 aa, Homo sapiens
  Native (PRAME_HUMAN)
KEEQYIAQFTSQFLSLQCLQ

SEQ ID NO: 344466 - protein, 21 aa, Homo sapiens
  Native (PRAME_HUMAN)
KEEQYIAQFTSQFLSLQCLQA

SEQ ID NO: 344467 - protein, 22 aa, Homo sapiens
  Native (PRAME_HUMAN)
KEEQYIAQFTSQFLSLQCLQAL

SEQ ID NO: 344468 - protein, 23 aa, Homo sapiens
  Native (PRAME_HUMAN)
KEEQYIAQFTSQFLSLQCLQALY

SEQ ID NO: 344469 - protein, 24 aa, Homo sapiens
  Native (PRAME_HUMAN)
KEEQYIAQFTSQFLSLQCLQALYV

SEQ ID NO: 344470 - protein, 25 aa, Homo sapiens
  Native (PRAME_HUMAN)
KEEQYIAQFTSQFLSLQCLQALYVD

SEQ ID NO: 344471 - protein, 14 aa, Homo sapiens
  Native (PRAME_HUMAN)
KEGACDELFSYLIE

SEQ ID NO: 344472 - protein, 15 aa, Homo sapiens
  Native (PRAME_HUMAN)
KEGACDELFSYLIEK

SEQ ID NO: 344473 - protein, 16 aa, Homo sapiens
  Native (PRAME_HUMAN)
KEGACDELFSYLIEKV

SEQ ID NO: 344474 - protein, 17 aa, Homo sapiens
  Native (PRAME_HUMAN)
KEGACDELFSYLIEKVK

SEQ ID NO: 344475 - protein, 18 aa, Homo sapiens
  Native (PRAME_HUMAN)
KEGACDELFSYLIEKVKR

SEQ ID NO: 344476 - protein, 19 aa, Homo sapiens
  Native (PRAME_HUMAN)
KEGACDELFSYLIEKVKRK

SEQ ID NO: 344477 - protein, 20 aa, Homo sapiens
  Native (PRAME_HUMAN)
KEGACDELFSYLIEKVKRKK

SEQ ID NO: 344478 - protein, 21 aa, Homo sapiens
  Native (PRAME_HUMAN)
KEGACDELFSYLIEKVKRKKN

SEQ ID NO: 344479 - protein, 22 aa, Homo sapiens
  Native (PRAME_HUMAN)
KEGACDELFSYLIEKVKRKKNV

SEQ ID NO: 344480 - protein, 23 aa, Homo sapiens
  Native (PRAME_HUMAN)
KEGACDELFSYLIEKVKRKKNVL

SEQ ID NO: 344481 - protein, 24 aa, Homo sapiens
  Native (PRAME_HUMAN)
KEGACDELFSYLIEKVKRKKNVLR

SEQ ID NO: 344482 - protein, 25 aa, Homo sapiens
  Native (PRAME_HUMAN)
KEGACDELFSYLIEKVKRKKNVLRL

SEQ ID NO: 344483 - protein, 13 aa, Homo sapiens
  Native (PRAME_HUMAN)
KFSPYLGQMINLR

SEQ ID NO: 344484 - protein, 14 aa, Homo sapiens
  Native (PRAME_HUMAN)
KFSPYLGQMINLRR

SEQ ID NO: 344485 - protein, 15 aa, Homo sapiens
  Native (PRAME_HUMAN)
KFSPYLGQMINLRRL

SEQ ID NO: 344486 - protein, 16 aa, Homo sapiens
  Native (PRAME_HUMAN)
KFSPYLGQMINLRRLL

SEQ ID NO: 344487 - protein, 17 aa, Homo sapiens
  Native (PRAME_HUMAN)
KFSPYLGQMINLRRLLL

SEQ ID NO: 344488 - protein, 18 aa, Homo sapiens
  Native (PRAME_HUMAN)
KFSPYLGQMINLRRLLLS

SEQ ID NO: 344489 - protein, 19 aa, Homo sapiens
  Native (PRAME_HUMAN)
KFSPYLGQMINLRRLLLSH

SEQ ID NO: 344490 - protein, 20 aa, Homo sapiens
  Native (PRAME_HUMAN)
KFSPYLGQMINLRRLLLSHI

SEQ ID NO: 344491 - protein, 21 aa, Homo sapiens
  Native (PRAME_HUMAN)
KFSPYLGQMINLRRLLLSHIH

SEQ ID NO: 344492 - protein, 22 aa, Homo sapiens
  Native (PRAME_HUMAN)
KFSPYLGQMINLRRLLLSHIHA

SEQ ID NO: 344493 - protein, 23 aa, Homo sapiens
  Native (PRAME_HUMAN)
KFSPYLGQMINLRRLLLSHIHAS

SEQ ID NO: 344494 - protein, 24 aa, Homo sapiens
  Native (PRAME_HUMAN)
KFSPYLGQMINLRRLLLSHIHASS

SEQ ID NO: 344495 - protein, 25 aa, Homo sapiens
  Native (PRAME_HUMAN)
KFSPYLGQMINLRRLLLSHIHASSY

SEQ ID NO: 344496 - protein, 13 aa, Homo sapiens
  Native (PRAME_HUMAN)
KGQHLHLETFKAV

SEQ ID NO: 344497 - protein, 14 aa, Homo sapiens
  Native (PRAME_HUMAN)
KGQHLHLETFKAVL

SEQ ID NO: 344498 - protein, 15 aa, Homo sapiens
  Native (PRAME_HUMAN)
KGQHLHLETFKAVLD

SEQ ID NO: 344499 - protein, 16 aa, Homo sapiens
  Native (PRAME_HUMAN)
KGQHLHLETFKAVLDG

SEQ ID NO: 344500 - protein, 17 aa, Homo sapiens
  Native (PRAME_HUMAN)
KGQHLHLETFKAVLDGL

SEQ ID NO: 344501 - protein, 18 aa, Homo sapiens
  Native (PRAME_HUMAN)
KGQHLHLETFKAVLDGLD

SEQ ID NO: 344502 - protein, 19 aa, Homo sapiens
  Native (PRAME_HUMAN)
KGQHLHLETFKAVLDGLDV

SEQ ID NO: 344503 - protein, 21 aa, Homo sapiens
  Native (PRAME_HUMAN)
KGQHLHLETFKAVLDGLDVLL

SEQ ID NO: 344504 - protein, 22 aa, Homo sapiens
  Native (PRAME_HUMAN)
KGQHLHLETFKAVLDGLDVLLA

SEQ ID NO: 344505 - protein, 23 aa, Homo sapiens
  Native (PRAME_HUMAN)
KGQHLHLETFKAVLDGLDVLLAQ

SEQ ID NO: 344506 - protein, 24 aa, Homo sapiens
  Native (PRAME_HUMAN)
KGQHLHLETFKAVLDGLDVLLAQE

SEQ ID NO: 344507 - protein, 25 aa, Homo sapiens
  Native (PRAME_HUMAN)
KGQHLHLETFKAVLDGLDVLLAQEV

SEQ ID NO: 344508 - protein, 13 aa, Homo sapiens
  Native (PRAME_HUMAN)
KIFAMPMQDIKMI

SEQ ID NO: 344509 - protein, 14 aa, Homo sapiens
  Native (PRAME_HUMAN)
KIFAMPMQDIKMIL

SEQ ID NO: 344510 - protein, 15 aa, Homo sapiens
  Native (PRAME_HUMAN)
KIFAMPMQDIKMILK

SEQ ID NO: 344511 - protein, 16 aa, Homo sapiens
  Native (PRAME_HUMAN)
KIFAMPMQDIKMILKM

SEQ ID NO: 344512 - protein, 17 aa, Homo sapiens
  Native (PRAME_HUMAN)
KIFAMPMQDIKMILKMV

SEQ ID NO: 344513 - protein, 18 aa, Homo sapiens
  Native (PRAME_HUMAN)
KIFAMPMQDIKMILKMVQ

SEQ ID NO: 344514 - protein, 19 aa, Homo sapiens
  Native (PRAME_HUMAN)
KIFAMPMQDIKMILKMVQL

SEQ ID NO: 344515 - protein, 20 aa, Homo sapiens
  Native (PRAME_HUMAN)
KIFAMPMQDIKMILKMVQLD

SEQ ID NO: 344516 - protein, 21 aa, Homo sapiens
  Native (PRAME_HUMAN)
KIFAMPMQDIKMILKMVQLDS

SEQ ID NO: 344517 - protein, 22 aa, Homo sapiens
  Native (PRAME_HUMAN)
KIFAMPMQDIKMILKMVQLDSI

SEQ ID NO: 344518 - protein, 23 aa, Homo sapiens
  Native (PRAME_HUMAN)
KIFAMPMQDIKMILKMVQLDSIE

SEQ ID NO: 344519 - protein, 24 aa, Homo sapiens
  Native (PRAME_HUMAN)
KIFAMPMQDIKMILKMVQLDSIED

SEQ ID NO: 344520 - protein, 25 aa, Homo sapiens
  Native (PRAME_HUMAN)
KIFAMPMQDIKMILKMVQLDSIEDL

SEQ ID NO: 344521 - protein, 13 aa, Homo sapiens
  Native (PRAME_HUMAN)
KKLKIFAMPMQDI

SEQ ID NO: 344522 - protein, 14 aa, Homo sapiens
  Native (PRAME_HUMAN)
KKLKIFAMPMQDIK

SEQ ID NO: 344523 - protein, 16 aa, Homo sapiens
  Native (PRAME_HUMAN)
KKLKIFAMPMQDIKMI

SEQ ID NO: 344524 - protein, 17 aa, Homo sapiens
  Native (PRAME_HUMAN)
KKLKIFAMPMQDIKMIL

SEQ ID NO: 344525 - protein, 18 aa, Homo sapiens
  Native (PRAME_HUMAN)
KKLKIFAMPMQDIKMILK

SEQ ID NO: 344526 - protein, 19 aa, Homo sapiens
  Native (PRAME_HUMAN)
KKLKIFAMPMQDIKMILKM

SEQ ID NO: 344527 - protein, 20 aa, Homo sapiens
  Native (PRAME_HUMAN)
KKLKIFAMPMQDIKMILKMV

SEQ ID NO: 344528 - protein, 21 aa, Homo sapiens
  Native (PRAME_HUMAN)
KKLKIFAMPMQDIKMILKMVQ

SEQ ID NO: 344529 - protein, 22 aa, Homo sapiens
  Native (PRAME_HUMAN)
KKLKIFAMPMQDIKMILKMVQL

SEQ ID NO: 344530 - protein, 23 aa, Homo sapiens
  Native (PRAME_HUMAN)
KKLKIFAMPMQDIKMILKMVQLD

SEQ ID NO: 344531 - protein, 24 aa, Homo sapiens
  Native (PRAME_HUMAN)
KKLKIFAMPMQDIKMILKMVQLDS

SEQ ID NO: 344532 - protein, 25 aa, Homo sapiens
  Native (PRAME_HUMAN)
KKLKIFAMPMQDIKMILKMVQLDSI

SEQ ID NO: 344533 - protein, 13 aa, Homo sapiens
  Native (PRAME_HUMAN)
KKNVLRLCCKKLK

SEQ ID NO: 344534 - protein, 14 aa, Homo sapiens
  Native (PRAME_HUMAN)
KKNVLRLCCKKLKI

SEQ ID NO: 344535 - protein, 15 aa, Homo sapiens
  Native (PRAME_HUMAN)
KKNVLRLCCKKLKIF

SEQ ID NO: 344536 - protein, 16 aa, Homo sapiens
  Native (PRAME_HUMAN)
KKNVLRLCCKKLKIFA

SEQ ID NO: 344537 - protein, 17 aa, Homo sapiens
  Native (PRAME_HUMAN)
KKNVLRLCCKKLKIFAM

SEQ ID NO: 344538 - protein, 18 aa, Homo sapiens
  Native (PRAME_HUMAN)
KKNVLRLCCKKLKIFAMP

SEQ ID NO: 344539 - protein, 19 aa, Homo sapiens
  Native (PRAME_HUMAN)
KKNVLRLCCKKLKIFAMPM

SEQ ID NO: 344540 - protein, 20 aa, Homo sapiens
  Native (PRAME_HUMAN)
KKNVLRLCCKKLKIFAMPMQ

SEQ ID NO: 344541 - protein, 21 aa, Homo sapiens
  Native (PRAME_HUMAN)
KKNVLRLCCKKLKIFAMPMQD

SEQ ID NO: 344542 - protein, 22 aa, Homo sapiens
  Native (PRAME_HUMAN)
KKNVLRLCCKKLKIFAMPMQDI

SEQ ID NO: 344543 - protein, 23 aa, Homo sapiens
  Native (PRAME_HUMAN)
KKNVLRLCCKKLKIFAMPMQDIK

SEQ ID NO: 344544 - protein, 24 aa, Homo sapiens
  Native (PRAME_HUMAN)
KKNVLRLCCKKLKIFAMPMQDIKM

SEQ ID NO: 344545 - protein, 25 aa, Homo sapiens
  Native (PRAME_HUMAN)
KKNVLRLCCKKLKIFAMPMQDIKMI

SEQ ID NO: 344546 - protein, 16 aa, Homo sapiens
  Native (PRAME_HUMAN)
KKRKVDGLSTEAEQPF

SEQ ID NO: 344547 - protein, 17 aa, Homo sapiens
  Native (PRAME_HUMAN)
KKRKVDGLSTEAEQPFI

SEQ ID NO: 344548 - protein, 18 aa, Homo sapiens
  Native (PRAME_HUMAN)
KKRKVDGLSTEAEQPFIP

SEQ ID NO: 344549 - protein, 19 aa, Homo sapiens
  Native (PRAME_HUMAN)
KKRKVDGLSTEAEQPFIPV

SEQ ID NO: 344550 - protein, 20 aa, Homo sapiens
  Native (PRAME_HUMAN)
KKRKVDGLSTEAEQPFIPVE

SEQ ID NO: 344551 - protein, 21 aa, Homo sapiens
  Native (PRAME_HUMAN)
KKRKVDGLSTEAEQPFIPVEV

SEQ ID NO: 344552 - protein, 22 aa, Homo sapiens
  Native (PRAME_HUMAN)
KKRKVDGLSTEAEQPFIPVEVL

SEQ ID NO: 344553 - protein, 23 aa, Homo sapiens
  Native (PRAME_HUMAN)
KKRKVDGLSTEAEQPFIPVEVLV

SEQ ID NO: 344554 - protein, 24 aa, Homo sapiens
  Native (PRAME_HUMAN)
KKRKVDGLSTEAEQPFIPVEVLVD

SEQ ID NO: 344555 - protein, 25 aa, Homo sapiens
  Native (PRAME_HUMAN)
KKRKVDGLSTEAEQPFIPVEVLVDL

SEQ ID NO: 344556 - protein, 13 aa, Homo sapiens
  Native (PRAME_HUMAN)
KLKIFAMPMQDIK

SEQ ID NO: 344557 - protein, 14 aa, Homo sapiens
  Native (PRAME_HUMAN)
KLKIFAMPMQDIKM

SEQ ID NO: 344558 - protein, 15 aa, Homo sapiens
  Native (PRAME_HUMAN)
KLKIFAMPMQDIKMI

SEQ ID NO: 344559 - protein, 16 aa, Homo sapiens
  Native (PRAME_HUMAN)
KLKIFAMPMQDIKMIL

SEQ ID NO: 344560 - protein, 17 aa, Homo sapiens
  Native (PRAME_HUMAN)
KLKIFAMPMQDIKMILK

SEQ ID NO: 344561 - protein, 18 aa, Homo sapiens
  Native (PRAME_HUMAN)
KLKIFAMPMQDIKMILKM

SEQ ID NO: 344562 - protein, 19 aa, Homo sapiens
  Native (PRAME_HUMAN)
KLKIFAMPMQDIKMILKMV

SEQ ID NO: 344563 - protein, 20 aa, Homo sapiens
  Native (PRAME_HUMAN)
KLKIFAMPMQDIKMILKMVQ

SEQ ID NO: 344564 - protein, 21 aa, Homo sapiens
  Native (PRAME_HUMAN)
KLKIFAMPMQDIKMILKMVQL

SEQ ID NO: 344565 - protein, 22 aa, Homo sapiens
  Native (PRAME_HUMAN)
KLKIFAMPMQDIKMILKMVQLD

SEQ ID NO: 344566 - protein, 23 aa, Homo sapiens
  Native (PRAME_HUMAN)
KLKIFAMPMQDIKMILKMVQLDS

SEQ ID NO: 344567 - protein, 24 aa, Homo sapiens
  Native (PRAME_HUMAN)
KLKIFAMPMQDIKMILKMVQLDSI

SEQ ID NO: 344568 - protein, 25 aa, Homo sapiens
  Native (PRAME_HUMAN)
KLKIFAMPMQDIKMILKMVQLDSIE

SEQ ID NO: 344569 - protein, 14 aa, Homo sapiens
  Native (PRAME_HUMAN)
KLPTLAKFSPYLGQ

SEQ ID NO: 344570 - protein, 15 aa, Homo sapiens
  Native (PRAME_HUMAN)
KLPTLAKFSPYLGQM

SEQ ID NO: 344571 - protein, 16 aa, Homo sapiens
  Native (PRAME_HUMAN)
KLPTLAKFSPYLGQMI

SEQ ID NO: 344572 - protein, 17 aa, Homo sapiens
  Native (PRAME_HUMAN)
KLPTLAKFSPYLGQMIN

SEQ ID NO: 344573 - protein, 18 aa, Homo sapiens
  Native (PRAME_HUMAN)
KLPTLAKFSPYLGQMINL

SEQ ID NO: 344574 - protein, 19 aa, Homo sapiens
  Native (PRAME_HUMAN)
KLPTLAKFSPYLGQMINLR

SEQ ID NO: 344575 - protein, 20 aa, Homo sapiens
  Native (PRAME_HUMAN)
KLPTLAKFSPYLGQMINLRR

SEQ ID NO: 344576 - protein, 21 aa, Homo sapiens
  Native (PRAME_HUMAN)
KLPTLAKFSPYLGQMINLRRL

SEQ ID NO: 344577 - protein, 22 aa, Homo sapiens
  Native (PRAME_HUMAN)
KLPTLAKFSPYLGQMINLRRLL

SEQ ID NO: 344578 - protein, 23 aa, Homo sapiens
  Native (PRAME_HUMAN)
KLPTLAKFSPYLGQMINLRRLLL

SEQ ID NO: 344579 - protein, 24 aa, Homo sapiens
  Native (PRAME_HUMAN)
KLPTLAKFSPYLGQMINLRRLLLS

SEQ ID NO: 344580 - protein, 25 aa, Homo sapiens
  Native (PRAME_HUMAN)
KLPTLAKFSPYLGQMINLRRLLLSH

SEQ ID NO: 344581 - protein, 14 aa, Homo sapiens
  Native (PRAME_HUMAN)
KLQVLDLRKNSHQD

SEQ ID NO: 344582 - protein, 15 aa, Homo sapiens
  Native (PRAME_HUMAN)
KLQVLDLRKNSHQDF

SEQ ID NO: 344583 - protein, 16 aa, Homo sapiens
  Native (PRAME_HUMAN)
KLQVLDLRKNSHQDFW

SEQ ID NO: 344584 - protein, 17 aa, Homo sapiens
  Native (PRAME_HUMAN)
KLQVLDLRKNSHQDFWT

SEQ ID NO: 344585 - protein, 18 aa, Homo sapiens
  Native (PRAME_HUMAN)
KLQVLDLRKNSHQDFWTV

SEQ ID NO: 344586 - protein, 19 aa, Homo sapiens
  Native (PRAME_HUMAN)
KLQVLDLRKNSHQDFWTVW

SEQ ID NO: 344587 - protein, 20 aa, Homo sapiens
  Native (PRAME_HUMAN)
KLQVLDLRKNSHQDFWTVWS

SEQ ID NO: 344588 - protein, 21 aa, Homo sapiens
  Native (PRAME_HUMAN)
KLQVLDLRKNSHQDFWTVWSG

SEQ ID NO: 344589 - protein, 22 aa, Homo sapiens
  Native (PRAME_HUMAN)
KLQVLDLRKNSHQDFWTVWSGN

SEQ ID NO: 344590 - protein, 23 aa, Homo sapiens
  Native (PRAME_HUMAN)
KLQVLDLRKNSHQDFWTVWSGNR

SEQ ID NO: 344591 - protein, 24 aa, Homo sapiens
  Native (PRAME_HUMAN)
KLQVLDLRKNSHQDFWTVWSGNRA

SEQ ID NO: 344592 - protein, 25 aa, Homo sapiens
  Native (PRAME_HUMAN)
KLQVLDLRKNSHQDFWTVWSGNRAS

SEQ ID NO: 344593 - protein, 13 aa, Homo sapiens
  Native (PRAME_HUMAN)
KMILKMVQLDSIE

SEQ ID NO: 344594 - protein, 14 aa, Homo sapiens
  Native (PRAME_HUMAN)
KMILKMVQLDSIED

SEQ ID NO: 344595 - protein, 15 aa, Homo sapiens
  Native (PRAME_HUMAN)
KMILKMVQLDSIEDL

SEQ ID NO: 344596 - protein, 16 aa, Homo sapiens
  Native (PRAME_HUMAN)
KMILKMVQLDSIEDLE

SEQ ID NO: 344597 - protein, 17 aa, Homo sapiens
  Native (PRAME_HUMAN)
KMILKMVQLDSIEDLEV

SEQ ID NO: 344598 - protein, 18 aa, Homo sapiens
  Native (PRAME_HUMAN)
KMILKMVQLDSIEDLEVT

SEQ ID NO: 344599 - protein, 19 aa, Homo sapiens
  Native (PRAME_HUMAN)
KMILKMVQLDSIEDLEVTC

SEQ ID NO: 344600 - protein, 20 aa, Homo sapiens
  Native (PRAME_HUMAN)
KMILKMVQLDSIEDLEVTCT

SEQ ID NO: 344601 - protein, 21 aa, Homo sapiens
  Native (PRAME_HUMAN)
KMILKMVQLDSIEDLEVTCTW

SEQ ID NO: 344602 - protein, 22 aa, Homo sapiens
  Native (PRAME_HUMAN)
KMILKMVQLDSIEDLEVTCTWK

SEQ ID NO: 344603 - protein, 23 aa, Homo sapiens
  Native (PRAME_HUMAN)
KMILKMVQLDSIEDLEVTCTWKL

SEQ ID NO: 344604 - protein, 24 aa, Homo sapiens
  Native (PRAME_HUMAN)
KMILKMVQLDSIEDLEVTCTWKLP

SEQ ID NO: 344605 - protein, 25 aa, Homo sapiens
  Native (PRAME_HUMAN)
KMILKMVQLDSIEDLEVTCTWKLPT

SEQ ID NO: 344606 - protein, 13 aa, Homo sapiens
  Native (PRAME_HUMAN)
KMVQLDSIEDLEV

SEQ ID NO: 344607 - protein, 14 aa, Homo sapiens
  Native (PRAME_HUMAN)
KMVQLDSIEDLEVT

SEQ ID NO: 344608 - protein, 15 aa, Homo sapiens
  Native (PRAME_HUMAN)
KMVQLDSIEDLEVTC

SEQ ID NO: 344609 - protein, 16 aa, Homo sapiens
  Native (PRAME_HUMAN)
KMVQLDSIEDLEVTCT

SEQ ID NO: 344610 - protein, 17 aa, Homo sapiens
  Native (PRAME_HUMAN)
KMVQLDSIEDLEVTCTW

SEQ ID NO: 344611 - protein, 18 aa, Homo sapiens
  Native (PRAME_HUMAN)
KMVQLDSIEDLEVTCTWK

SEQ ID NO: 344612 - protein, 19 aa, Homo sapiens
  Native (PRAME_HUMAN)
KMVQLDSIEDLEVTCTWKL

SEQ ID NO: 344613 - protein, 20 aa, Homo sapiens
  Native (PRAME_HUMAN)
KMVQLDSIEDLEVTCTWKLP

SEQ ID NO: 344614 - protein, 21 aa, Homo sapiens
  Native (PRAME_HUMAN)
KMVQLDSIEDLEVTCTWKLPT

SEQ ID NO: 344615 - protein, 22 aa, Homo sapiens
  Native (PRAME_HUMAN)
KMVQLDSIEDLEVTCTWKLPTL

SEQ ID NO: 344616 - protein, 23 aa, Homo sapiens
  Native (PRAME_HUMAN)
KMVQLDSIEDLEVTCTWKLPTLA

SEQ ID NO: 344617 - protein, 24 aa, Homo sapiens
  Native (PRAME_HUMAN)
KMVQLDSIEDLEVTCTWKLPTLAK

SEQ ID NO: 344618 - protein, 25 aa, Homo sapiens
  Native (PRAME_HUMAN)
KMVQLDSIEDLEVTCTWKLPTLAKF

SEQ ID NO: 344619 - protein, 16 aa, Homo sapiens
  Native (PRAME_HUMAN)
KNSHQDFWTVWSGNRA

SEQ ID NO: 344620 - protein, 17 aa, Homo sapiens
  Native (PRAME_HUMAN)
KNSHQDFWTVWSGNRAS

SEQ ID NO: 344621 - protein, 18 aa, Homo sapiens
  Native (PRAME_HUMAN)
KNSHQDFWTVWSGNRASL

SEQ ID NO: 344622 - protein, 19 aa, Homo sapiens
  Native (PRAME_HUMAN)
KNSHQDFWTVWSGNRASLY

SEQ ID NO: 344623 - protein, 20 aa, Homo sapiens
  Native (PRAME_HUMAN)
KNSHQDFWTVWSGNRASLYS

SEQ ID NO: 344624 - protein, 21 aa, Homo sapiens
  Native (PRAME_HUMAN)
KNSHQDFWTVWSGNRASLYSF

SEQ ID NO: 344625 - protein, 22 aa, Homo sapiens
  Native (PRAME_HUMAN)
KNSHQDFWTVWSGNRASLYSFP

SEQ ID NO: 344626 - protein, 23 aa, Homo sapiens
  Native (PRAME_HUMAN)
KNSHQDFWTVWSGNRASLYSFPE

SEQ ID NO: 344627 - protein, 24 aa, Homo sapiens
  Native (PRAME_HUMAN)
KNSHQDFWTVWSGNRASLYSFPEP

SEQ ID NO: 344628 - protein, 25 aa, Homo sapiens
  Native (PRAME_HUMAN)
KNSHQDFWTVWSGNRASLYSFPEPE

SEQ ID NO: 344629 - protein, 13 aa, Homo sapiens
  Native (PRAME_HUMAN)
KNVLRLCCKKLKI

SEQ ID NO: 344630 - protein, 14 aa, Homo sapiens
  Native (PRAME_HUMAN)
KNVLRLCCKKLKIF

SEQ ID NO: 344631 - protein, 15 aa, Homo sapiens
  Native (PRAME_HUMAN)
KNVLRLCCKKLKIFA

SEQ ID NO: 344632 - protein, 16 aa, Homo sapiens
  Native (PRAME_HUMAN)
KNVLRLCCKKLKIFAM

SEQ ID NO: 344633 - protein, 17 aa, Homo sapiens
  Native (PRAME_HUMAN)
KNVLRLCCKKLKIFAMP

SEQ ID NO: 344634 - protein, 18 aa, Homo sapiens
  Native (PRAME_HUMAN)
KNVLRLCCKKLKIFAMPM

SEQ ID NO: 344635 - protein, 19 aa, Homo sapiens
  Native (PRAME_HUMAN)
KNVLRLCCKKLKIFAMPMQ

SEQ ID NO: 344636 - protein, 20 aa, Homo sapiens
  Native (PRAME_HUMAN)
KNVLRLCCKKLKIFAMPMQD

SEQ ID NO: 344637 - protein, 21 aa, Homo sapiens
  Native (PRAME_HUMAN)
KNVLRLCCKKLKIFAMPMQDI

SEQ ID NO: 344638 - protein, 22 aa, Homo sapiens
  Native (PRAME_HUMAN)
KNVLRLCCKKLKIFAMPMQDIK

SEQ ID NO: 344639 - protein, 23 aa, Homo sapiens
  Native (PRAME_HUMAN)
KNVLRLCCKKLKIFAMPMQDIKM

SEQ ID NO: 344640 - protein, 24 aa, Homo sapiens
  Native (PRAME_HUMAN)
KNVLRLCCKKLKIFAMPMQDIKMI

SEQ ID NO: 344641 - protein, 25 aa, Homo sapiens
  Native (PRAME_HUMAN)
KNVLRLCCKKLKIFAMPMQDIKMIL

SEQ ID NO: 344642 - protein, 14 aa, Homo sapiens
  Native (PRAME_HUMAN)
KRKKNVLRLCCKKL

SEQ ID NO: 344643 - protein, 15 aa, Homo sapiens
  Native (PRAME_HUMAN)
KRKKNVLRLCCKKLK

SEQ ID NO: 344644 - protein, 16 aa, Homo sapiens
  Native (PRAME_HUMAN)
KRKKNVLRLCCKKLKI

SEQ ID NO: 344645 - protein, 17 aa, Homo sapiens
  Native (PRAME_HUMAN)
KRKKNVLRLCCKKLKIF

SEQ ID NO: 344646 - protein, 18 aa, Homo sapiens
  Native (PRAME_HUMAN)
KRKKNVLRLCCKKLKIFA

SEQ ID NO: 344647 - protein, 19 aa, Homo sapiens
  Native (PRAME_HUMAN)
KRKKNVLRLCCKKLKIFAM

SEQ ID NO: 344648 - protein, 20 aa, Homo sapiens
  Native (PRAME_HUMAN)
KRKKNVLRLCCKKLKIFAMP

SEQ ID NO: 344649 - protein, 21 aa, Homo sapiens
  Native (PRAME_HUMAN)
KRKKNVLRLCCKKLKIFAMPM

SEQ ID NO: 344650 - protein, 22 aa, Homo sapiens
  Native (PRAME_HUMAN)
KRKKNVLRLCCKKLKIFAMPMQ

SEQ ID NO: 344651 - protein, 23 aa, Homo sapiens
  Native (PRAME_HUMAN)
KRKKNVLRLCCKKLKIFAMPMQD

SEQ ID NO: 344652 - protein, 24 aa, Homo sapiens
  Native (PRAME_HUMAN)
KRKKNVLRLCCKKLKIFAMPMQDI

SEQ ID NO: 344653 - protein, 25 aa, Homo sapiens
  Native (PRAME_HUMAN)
KRKKNVLRLCCKKLKIFAMPMQDIK

SEQ ID NO: 344654 - protein, 15 aa, Homo sapiens
  Native (PRAME_HUMAN)
KRKVDGLSTEAEQPF

SEQ ID NO: 344655 - protein, 16 aa, Homo sapiens
  Native (PRAME_HUMAN)
KRKVDGLSTEAEQPFI

SEQ ID NO: 344656 - protein, 17 aa, Homo sapiens
  Native (PRAME_HUMAN)
KRKVDGLSTEAEQPFIP

SEQ ID NO: 344657 - protein, 18 aa, Homo sapiens
  Native (PRAME_HUMAN)
KRKVDGLSTEAEQPFIPV

SEQ ID NO: 344658 - protein, 19 aa, Homo sapiens
  Native (PRAME_HUMAN)
KRKVDGLSTEAEQPFIPVE

SEQ ID NO: 344659 - protein, 20 aa, Homo sapiens
  Native (PRAME_HUMAN)
KRKVDGLSTEAEQPFIPVEV

SEQ ID NO: 344660 - protein, 21 aa, Homo sapiens
  Native (PRAME_HUMAN)
KRKVDGLSTEAEQPFIPVEVL

SEQ ID NO: 344661 - protein, 22 aa, Homo sapiens
  Native (PRAME_HUMAN)
KRKVDGLSTEAEQPFIPVEVLV

SEQ ID NO: 344662 - protein, 23 aa, Homo sapiens
  Native (PRAME_HUMAN)
KRKVDGLSTEAEQPFIPVEVLVD

SEQ ID NO: 344663 - protein, 24 aa, Homo sapiens
  Native (PRAME_HUMAN)
KRKVDGLSTEAEQPFIPVEVLVDL

SEQ ID NO: 344664 - protein, 25 aa, Homo sapiens
  Native (PRAME_HUMAN)
KRKVDGLSTEAEQPFIPVEVLVDLF

SEQ ID NO: 344665 - protein, 13 aa, Homo sapiens
  Native (PRAME_HUMAN)
KVDGLSTEAEQPF

SEQ ID NO: 344666 - protein, 14 aa, Homo sapiens
  Native (PRAME_HUMAN)
KVDGLSTEAEQPFI

SEQ ID NO: 344667 - protein, 15 aa, Homo sapiens
  Native (PRAME_HUMAN)
KVDGLSTEAEQPFIP

SEQ ID NO: 344668 - protein, 16 aa, Homo sapiens
  Native (PRAME_HUMAN)
KVDGLSTEAEQPFIPV

SEQ ID NO: 344669 - protein, 17 aa, Homo sapiens
  Native (PRAME_HUMAN)
KVDGLSTEAEQPFIPVE

SEQ ID NO: 344670 - protein, 18 aa, Homo sapiens
  Native (PRAME_HUMAN)
KVDGLSTEAEQPFIPVEV

SEQ ID NO: 344671 - protein, 19 aa, Homo sapiens
  Native (PRAME_HUMAN)
KVDGLSTEAEQPFIPVEVL

SEQ ID NO: 344672 - protein, 20 aa, Homo sapiens
  Native (PRAME_HUMAN)
KVDGLSTEAEQPFIPVEVLV

SEQ ID NO: 344673 - protein, 21 aa, Homo sapiens
  Native (PRAME_HUMAN)
KVDGLSTEAEQPFIPVEVLVD

SEQ ID NO: 344674 - protein, 22 aa, Homo sapiens
  Native (PRAME_HUMAN)
KVDGLSTEAEQPFIPVEVLVDL

SEQ ID NO: 344675 - protein, 23 aa, Homo sapiens
  Native (PRAME_HUMAN)
KVDGLSTEAEQPFIPVEVLVDLF

SEQ ID NO: 344676 - protein, 24 aa, Homo sapiens
  Native (PRAME_HUMAN)
KVDGLSTEAEQPFIPVEVLVDLFL

SEQ ID NO: 344677 - protein, 25 aa, Homo sapiens
  Native (PRAME_HUMAN)
KVDGLSTEAEQPFIPVEVLVDLFLK

SEQ ID NO: 344678 - protein, 14 aa, Homo sapiens
  Native (PRAME_HUMAN)
KVKRKKNVLRLCCK

SEQ ID NO: 344679 - protein, 15 aa, Homo sapiens
  Native (PRAME_HUMAN)
KVKRKKNVLRLCCKK

SEQ ID NO: 344680 - protein, 16 aa, Homo sapiens
  Native (PRAME_HUMAN)
KVKRKKNVLRLCCKKL

SEQ ID NO: 344681 - protein, 17 aa, Homo sapiens
  Native (PRAME_HUMAN)
KVKRKKNVLRLCCKKLK

SEQ ID NO: 344682 - protein, 18 aa, Homo sapiens
  Native (PRAME_HUMAN)
KVKRKKNVLRLCCKKLKI

SEQ ID NO: 344683 - protein, 19 aa, Homo sapiens
  Native (PRAME_HUMAN)
KVKRKKNVLRLCCKKLKIF

SEQ ID NO: 344684 - protein, 20 aa, Homo sapiens
  Native (PRAME_HUMAN)
KVKRKKNVLRLCCKKLKIFA

SEQ ID NO: 344685 - protein, 21 aa, Homo sapiens
  Native (PRAME_HUMAN)
KVKRKKNVLRLCCKKLKIFAM

SEQ ID NO: 344686 - protein, 22 aa, Homo sapiens
  Native (PRAME_HUMAN)
KVKRKKNVLRLCCKKLKIFAMP

SEQ ID NO: 344687 - protein, 23 aa, Homo sapiens
  Native (PRAME_HUMAN)
KVKRKKNVLRLCCKKLKIFAMPM

SEQ ID NO: 344688 - protein, 24 aa, Homo sapiens
  Native (PRAME_HUMAN)
KVKRKKNVLRLCCKKLKIFAMPMQ

SEQ ID NO: 344689 - protein, 25 aa, Homo sapiens
  Native (PRAME_HUMAN)
KVKRKKNVLRLCCKKLKIFAMPMQD

SEQ ID NO: 344690 - protein, 14 aa, Homo sapiens
  Native (PRAME_HUMAN)
LAGQSLLKDEALAI

SEQ ID NO: 344691 - protein, 15 aa, Homo sapiens
  Native (PRAME_HUMAN)
LAGQSLLKDEALAIA

SEQ ID NO: 344692 - protein, 16 aa, Homo sapiens
  Native (PRAME_HUMAN)
LAGQSLLKDEALAIAA

SEQ ID NO: 344693 - protein, 17 aa, Homo sapiens
  Native (PRAME_HUMAN)
LAGQSLLKDEALAIAAL

SEQ ID NO: 344694 - protein, 18 aa, Homo sapiens
  Native (PRAME_HUMAN)
LAGQSLLKDEALAIAALE

SEQ ID NO: 344695 - protein, 19 aa, Homo sapiens
  Native (PRAME_HUMAN)
LAGQSLLKDEALAIAALEL

SEQ ID NO: 344696 - protein, 20 aa, Homo sapiens
  Native (PRAME_HUMAN)
LAGQSLLKDEALAIAALELL

SEQ ID NO: 344697 - protein, 21 aa, Homo sapiens
  Native (PRAME_HUMAN)
LAGQSLLKDEALAIAALELLP

SEQ ID NO: 344698 - protein, 22 aa, Homo sapiens
  Native (PRAME_HUMAN)
LAGQSLLKDEALAIAALELLPR

SEQ ID NO: 344699 - protein, 23 aa, Homo sapiens
  Native (PRAME_HUMAN)
LAGQSLLKDEALAIAALELLPRE

SEQ ID NO: 344700 - protein, 24 aa, Homo sapiens
  Native (PRAME_HUMAN)
LAGQSLLKDEALAIAALELLPREL

SEQ ID NO: 344701 - protein, 25 aa, Homo sapiens
  Native (PRAME_HUMAN)
LAGQSLLKDEALAIAALELLPRELF

SEQ ID NO: 344702 - protein, 13 aa, Homo sapiens
  Native (PRAME_HUMAN)
LAIAALELLPREL

SEQ ID NO: 344703 - protein, 14 aa, Homo sapiens
  Native (PRAME_HUMAN)
LAIAALELLPRELF

SEQ ID NO: 344704 - protein, 15 aa, Homo sapiens
  Native (PRAME_HUMAN)
LAIAALELLPRELFP

SEQ ID NO: 344705 - protein, 16 aa, Homo sapiens
  Native (PRAME_HUMAN)
LAIAALELLPRELFPP

SEQ ID NO: 344706 - protein, 17 aa, Homo sapiens
  Native (PRAME_HUMAN)
LAIAALELLPRELFPPL

SEQ ID NO: 344707 - protein, 18 aa, Homo sapiens
  Native (PRAME_HUMAN)
LAIAALELLPRELFPPLF

SEQ ID NO: 344708 - protein, 19 aa, Homo sapiens
  Native (PRAME_HUMAN)
LAIAALELLPRELFPPLFM

SEQ ID NO: 344709 - protein, 20 aa, Homo sapiens
  Native (PRAME_HUMAN)
LAIAALELLPRELFPPLFMA

SEQ ID NO: 344710 - protein, 21 aa, Homo sapiens
  Native (PRAME_HUMAN)
LAIAALELLPRELFPPLFMAA

SEQ ID NO: 344711 - protein, 22 aa, Homo sapiens
  Native (PRAME_HUMAN)
LAIAALELLPRELFPPLFMAAF

SEQ ID NO: 344712 - protein, 23 aa, Homo sapiens
  Native (PRAME_HUMAN)
LAIAALELLPRELFPPLFMAAFD

SEQ ID NO: 344713 - protein, 24 aa, Homo sapiens
  Native (PRAME_HUMAN)
LAIAALELLPRELFPPLFMAAFDG

SEQ ID NO: 344714 - protein, 25 aa, Homo sapiens
  Native (PRAME_HUMAN)
LAIAALELLPRELFPPLFMAAFDGR

SEQ ID NO: 344715 - protein, 13 aa, Homo sapiens
  Native (PRAME_HUMAN)
LAKFSPYLGQMIN

SEQ ID NO: 344716 - protein, 14 aa, Homo sapiens
  Native (PRAME_HUMAN)
LAKFSPYLGQMINL

SEQ ID NO: 344717 - protein, 15 aa, Homo sapiens
  Native (PRAME_HUMAN)
LAKFSPYLGQMINLR

SEQ ID NO: 344718 - protein, 16 aa, Homo sapiens
  Native (PRAME_HUMAN)
LAKFSPYLGQMINLRR

SEQ ID NO: 344719 - protein, 17 aa, Homo sapiens
  Native (PRAME_HUMAN)
LAKFSPYLGQMINLRRL

SEQ ID NO: 344720 - protein, 18 aa, Homo sapiens
  Native (PRAME_HUMAN)
LAKFSPYLGQMINLRRLL

SEQ ID NO: 344721 - protein, 19 aa, Homo sapiens
  Native (PRAME_HUMAN)
LAKFSPYLGQMINLRRLLL

SEQ ID NO: 344722 - protein, 20 aa, Homo sapiens
  Native (PRAME_HUMAN)
LAKFSPYLGQMINLRRLLLS

SEQ ID NO: 344723 - protein, 21 aa, Homo sapiens
  Native (PRAME_HUMAN)
LAKFSPYLGQMINLRRLLLSH

SEQ ID NO: 344724 - protein, 22 aa, Homo sapiens
  Native (PRAME_HUMAN)
LAKFSPYLGQMINLRRLLLSHI

SEQ ID NO: 344725 - protein, 23 aa, Homo sapiens
  Native (PRAME_HUMAN)
LAKFSPYLGQMINLRRLLLSHIH

SEQ ID NO: 344726 - protein, 24 aa, Homo sapiens
  Native (PRAME_HUMAN)
LAKFSPYLGQMINLRRLLLSHIHA

SEQ ID NO: 344727 - protein, 25 aa, Homo sapiens
  Native (PRAME_HUMAN)
LAKFSPYLGQMINLRRLLLSHIHAS

SEQ ID NO: 344728 - protein, 13 aa, Homo sapiens
  Native (PRAME_HUMAN)
LALLPSLSHCSQL

SEQ ID NO: 344729 - protein, 14 aa, Homo sapiens
  Native (PRAME_HUMAN)
LALLPSLSHCSQLT

SEQ ID NO: 344730 - protein, 15 aa, Homo sapiens
  Native (PRAME_HUMAN)
LALLPSLSHCSQLTT

SEQ ID NO: 344731 - protein, 16 aa, Homo sapiens
  Native (PRAME_HUMAN)
LALLPSLSHCSQLTTL

SEQ ID NO: 344732 - protein, 17 aa, Homo sapiens
  Native (PRAME_HUMAN)
LALLPSLSHCSQLTTLS

SEQ ID NO: 344733 - protein, 18 aa, Homo sapiens
  Native (PRAME_HUMAN)
LALLPSLSHCSQLTTLSF

SEQ ID NO: 344734 - protein, 19 aa, Homo sapiens
  Native (PRAME_HUMAN)
LALLPSLSHCSQLTTLSFY

SEQ ID NO: 344735 - protein, 20 aa, Homo sapiens
  Native (PRAME_HUMAN)
LALLPSLSHCSQLTTLSFYG

SEQ ID NO: 344736 - protein, 21 aa, Homo sapiens
  Native (PRAME_HUMAN)
LALLPSLSHCSQLTTLSFYGN

SEQ ID NO: 344737 - protein, 22 aa, Homo sapiens
  Native (PRAME_HUMAN)
LALLPSLSHCSQLTTLSFYGNS

SEQ ID NO: 344738 - protein, 23 aa, Homo sapiens
  Native (PRAME_HUMAN)
LALLPSLSHCSQLTTLSFYGNSI

SEQ ID NO: 344739 - protein, 24 aa, Homo sapiens
  Native (PRAME_HUMAN)
LALLPSLSHCSQLTTLSFYGNSIS

SEQ ID NO: 344740 - protein, 25 aa, Homo sapiens
  Native (PRAME_HUMAN)
LALLPSLSHCSQLTTLSFYGNSISI

SEQ ID NO: 344741 - protein, 15 aa, Homo sapiens
  Native (PRAME_HUMAN)
LAQEVRPRRWKLQVL

SEQ ID NO: 344742 - protein, 16 aa, Homo sapiens
  Native (PRAME_HUMAN)
LAQEVRPRRWKLQVLD

SEQ ID NO: 344743 - protein, 17 aa, Homo sapiens
  Native (PRAME_HUMAN)
LAQEVRPRRWKLQVLDL

SEQ ID NO: 344744 - protein, 18 aa, Homo sapiens
  Native (PRAME_HUMAN)
LAQEVRPRRWKLQVLDLR

SEQ ID NO: 344745 - protein, 19 aa, Homo sapiens
  Native (PRAME_HUMAN)
LAQEVRPRRWKLQVLDLRK

SEQ ID NO: 344746 - protein, 20 aa, Homo sapiens
  Native (PRAME_HUMAN)
LAQEVRPRRWKLQVLDLRKN

SEQ ID NO: 344747 - protein, 21 aa, Homo sapiens
  Native (PRAME_HUMAN)
LAQEVRPRRWKLQVLDLRKNS

SEQ ID NO: 344748 - protein, 22 aa, Homo sapiens
  Native (PRAME_HUMAN)
LAQEVRPRRWKLQVLDLRKNSH

SEQ ID NO: 344749 - protein, 23 aa, Homo sapiens
  Native (PRAME_HUMAN)
LAQEVRPRRWKLQVLDLRKNSHQ

SEQ ID NO: 344750 - protein, 24 aa, Homo sapiens
  Native (PRAME_HUMAN)
LAQEVRPRRWKLQVLDLRKNSHQD

SEQ ID NO: 344751 - protein, 25 aa, Homo sapiens
  Native (PRAME_HUMAN)
LAQEVRPRRWKLQVLDLRKNSHQDF

SEQ ID NO: 344752 - protein, 13 aa, Homo sapiens
  Native (PRAME_HUMAN)
LAYLHARLRELLC

SEQ ID NO: 344753 - protein, 14 aa, Homo sapiens
  Native (PRAME_HUMAN)
LAYLHARLRELLCE

SEQ ID NO: 344754 - protein, 15 aa, Homo sapiens
  Native (PRAME_HUMAN)
LAYLHARLRELLCEL

SEQ ID NO: 344755 - protein, 16 aa, Homo sapiens
  Native (PRAME_HUMAN)
LAYLHARLRELLCELG

SEQ ID NO: 344756 - protein, 17 aa, Homo sapiens
  Native (PRAME_HUMAN)
LAYLHARLRELLCELGR

SEQ ID NO: 344757 - protein, 18 aa, Homo sapiens
  Native (PRAME_HUMAN)
LAYLHARLRELLCELGRP

SEQ ID NO: 344758 - protein, 19 aa, Homo sapiens
  Native (PRAME_HUMAN)
LAYLHARLRELLCELGRPS

SEQ ID NO: 344759 - protein, 20 aa, Homo sapiens
  Native (PRAME_HUMAN)
LAYLHARLRELLCELGRPSM

SEQ ID NO: 344760 - protein, 21 aa, Homo sapiens
  Native (PRAME_HUMAN)
LAYLHARLRELLCELGRPSMV

SEQ ID NO: 344761 - protein, 22 aa, Homo sapiens
  Native (PRAME_HUMAN)
LAYLHARLRELLCELGRPSMVW

SEQ ID NO: 344762 - protein, 23 aa, Homo sapiens
  Native (PRAME_HUMAN)
LAYLHARLRELLCELGRPSMVWL

SEQ ID NO: 344763 - protein, 24 aa, Homo sapiens
  Native (PRAME_HUMAN)
LAYLHARLRELLCELGRPSMVWLS

SEQ ID NO: 344764 - protein, 25 aa, Homo sapiens
  Native (PRAME_HUMAN)
LAYLHARLRELLCELGRPSMVWLSA

SEQ ID NO: 344765 - protein, 14 aa, Homo sapiens
  Native (PRAME_HUMAN)
LCCKKLKIFAMPMQ

SEQ ID NO: 344766 - protein, 15 aa, Homo sapiens
  Native (PRAME_HUMAN)
LCCKKLKIFAMPMQD

SEQ ID NO: 344767 - protein, 16 aa, Homo sapiens
  Native (PRAME_HUMAN)
LCCKKLKIFAMPMQDI

SEQ ID NO: 344768 - protein, 17 aa, Homo sapiens
  Native (PRAME_HUMAN)
LCCKKLKIFAMPMQDIK

SEQ ID NO: 344769 - protein, 18 aa, Homo sapiens
  Native (PRAME_HUMAN)
LCCKKLKIFAMPMQDIKM

SEQ ID NO: 344770 - protein, 19 aa, Homo sapiens
  Native (PRAME_HUMAN)
LCCKKLKIFAMPMQDIKMI

SEQ ID NO: 344771 - protein, 20 aa, Homo sapiens
  Native (PRAME_HUMAN)
LCCKKLKIFAMPMQDIKMIL

SEQ ID NO: 344772 - protein, 21 aa, Homo sapiens
  Native (PRAME_HUMAN)
LCCKKLKIFAMPMQDIKMILK

SEQ ID NO: 344773 - protein, 22 aa, Homo sapiens
  Native (PRAME_HUMAN)
LCCKKLKIFAMPMQDIKMILKM

SEQ ID NO: 344774 - protein, 23 aa, Homo sapiens
  Native (PRAME_HUMAN)
LCCKKLKIFAMPMQDIKMILKMV

SEQ ID NO: 344775 - protein, 24 aa, Homo sapiens
  Native (PRAME_HUMAN)
LCCKKLKIFAMPMQDIKMILKMVQ

SEQ ID NO: 344776 - protein, 25 aa, Homo sapiens
  Native (PRAME_HUMAN)
LCCKKLKIFAMPMQDIKMILKMVQL

SEQ ID NO: 344777 - protein, 13 aa, Homo sapiens
  Native (PRAME_HUMAN)
LCELGRPSMVWLS

SEQ ID NO: 344778 - protein, 14 aa, Homo sapiens
  Native (PRAME_HUMAN)
LCELGRPSMVWLSA

SEQ ID NO: 344779 - protein, 15 aa, Homo sapiens
  Native (PRAME_HUMAN)
LCELGRPSMVWLSAN

SEQ ID NO: 344780 - protein, 16 aa, Homo sapiens
  Native (PRAME_HUMAN)
LCELGRPSMVWLSANP

SEQ ID NO: 344781 - protein, 17 aa, Homo sapiens
  Native (PRAME_HUMAN)
LCELGRPSMVWLSANPC

SEQ ID NO: 344782 - protein, 18 aa, Homo sapiens
  Native (PRAME_HUMAN)
LCELGRPSMVWLSANPCP

SEQ ID NO: 344783 - protein, 19 aa, Homo sapiens
  Native (PRAME_HUMAN)
LCELGRPSMVWLSANPCPH

SEQ ID NO: 344784 - protein, 20 aa, Homo sapiens
  Native (PRAME_HUMAN)
LCELGRPSMVWLSANPCPHC

SEQ ID NO: 344785 - protein, 21 aa, Homo sapiens
  Native (PRAME_HUMAN)
LCELGRPSMVWLSANPCPHCG

SEQ ID NO: 344786 - protein, 22 aa, Homo sapiens
  Native (PRAME_HUMAN)
LCELGRPSMVWLSANPCPHCGD

SEQ ID NO: 344787 - protein, 23 aa, Homo sapiens
  Native (PRAME_HUMAN)
LCELGRPSMVWLSANPCPHCGDR

SEQ ID NO: 344788 - protein, 24 aa, Homo sapiens
  Native (PRAME_HUMAN)
LCELGRPSMVWLSANPCPHCGDRT

SEQ ID NO: 344789 - protein, 25 aa, Homo sapiens
  Native (PRAME_HUMAN)
LCELGRPSMVWLSANPCPHCGDRTF

SEQ ID NO: 344790 - protein, 14 aa, Homo sapiens
  Native (PRAME_HUMAN)
LDGLDVLLAQEVRP

SEQ ID NO: 344791 - protein, 15 aa, Homo sapiens
  Native (PRAME_HUMAN)
LDGLDVLLAQEVRPR

SEQ ID NO: 344792 - protein, 16 aa, Homo sapiens
  Native (PRAME_HUMAN)
LDGLDVLLAQEVRPRR

SEQ ID NO: 344793 - protein, 17 aa, Homo sapiens
  Native (PRAME_HUMAN)
LDGLDVLLAQEVRPRRW

SEQ ID NO: 344794 - protein, 18 aa, Homo sapiens
  Native (PRAME_HUMAN)
LDGLDVLLAQEVRPRRWK

SEQ ID NO: 344795 - protein, 19 aa, Homo sapiens
  Native (PRAME_HUMAN)
LDGLDVLLAQEVRPRRWKL

SEQ ID NO: 344796 - protein, 20 aa, Homo sapiens
  Native (PRAME_HUMAN)
LDGLDVLLAQEVRPRRWKLQ

SEQ ID NO: 344797 - protein, 21 aa, Homo sapiens
  Native (PRAME_HUMAN)
LDGLDVLLAQEVRPRRWKLQV

SEQ ID NO: 344798 - protein, 22 aa, Homo sapiens
  Native (PRAME_HUMAN)
LDGLDVLLAQEVRPRRWKLQVL

SEQ ID NO: 344799 - protein, 23 aa, Homo sapiens
  Native (PRAME_HUMAN)
LDGLDVLLAQEVRPRRWKLQVLD

SEQ ID NO: 344800 - protein, 24 aa, Homo sapiens
  Native (PRAME_HUMAN)
LDGLDVLLAQEVRPRRWKLQVLDL

SEQ ID NO: 344801 - protein, 25 aa, Homo sapiens
  Native (PRAME_HUMAN)
LDGLDVLLAQEVRPRRWKLQVLDLR

SEQ ID NO: 344802 - protein, 14 aa, Homo sapiens
  Native (PRAME_HUMAN)
LDLRKNSHQDFWTV

SEQ ID NO: 344803 - protein, 15 aa, Homo sapiens
  Native (PRAME_HUMAN)
LDLRKNSHQDFWTVW

SEQ ID NO: 344804 - protein, 16 aa, Homo sapiens
  Native (PRAME_HUMAN)
LDLRKNSHQDFWTVWS

SEQ ID NO: 344805 - protein, 17 aa, Homo sapiens
  Native (PRAME_HUMAN)
LDLRKNSHQDFWTVWSG

SEQ ID NO: 344806 - protein, 19 aa, Homo sapiens
  Native (PRAME_HUMAN)
LDLRKNSHQDFWTVWSGNR

SEQ ID NO: 344807 - protein, 20 aa, Homo sapiens
  Native (PRAME_HUMAN)
LDLRKNSHQDFWTVWSGNRA

SEQ ID NO: 344808 - protein, 21 aa, Homo sapiens
  Native (PRAME_HUMAN)
LDLRKNSHQDFWTVWSGNRAS

SEQ ID NO: 344809 - protein, 22 aa, Homo sapiens
  Native (PRAME_HUMAN)
LDLRKNSHQDFWTVWSGNRASL

SEQ ID NO: 344810 - protein, 23 aa, Homo sapiens
  Native (PRAME_HUMAN)
LDLRKNSHQDFWTVWSGNRASLY

SEQ ID NO: 344811 - protein, 24 aa, Homo sapiens
  Native (PRAME_HUMAN)
LDLRKNSHQDFWTVWSGNRASLYS

SEQ ID NO: 344812 - protein, 25 aa, Homo sapiens
  Native (PRAME_HUMAN)
LDLRKNSHQDFWTVWSGNRASLYSF

SEQ ID NO: 344813 - protein, 13 aa, Homo sapiens
  Native (PRAME_HUMAN)
LDQLLRHVMNPLE

SEQ ID NO: 344814 - protein, 14 aa, Homo sapiens
  Native (PRAME_HUMAN)
LDQLLRHVMNPLET

SEQ ID NO: 344815 - protein, 15 aa, Homo sapiens
  Native (PRAME_HUMAN)
LDQLLRHVMNPLETL

SEQ ID NO: 344816 - protein, 16 aa, Homo sapiens
  Native (PRAME_HUMAN)
LDQLLRHVMNPLETLS

SEQ ID NO: 344817 - protein, 17 aa, Homo sapiens
  Native (PRAME_HUMAN)
LDQLLRHVMNPLETLSI

SEQ ID NO: 344818 - protein, 18 aa, Homo sapiens
  Native (PRAME_HUMAN)
LDQLLRHVMNPLETLSIT

SEQ ID NO: 344819 - protein, 19 aa, Homo sapiens
  Native (PRAME_HUMAN)
LDQLLRHVMNPLETLSITN

SEQ ID NO: 344820 - protein, 20 aa, Homo sapiens
  Native (PRAME_HUMAN)
LDQLLRHVMNPLETLSITNC

SEQ ID NO: 344821 - protein, 21 aa, Homo sapiens
  Native (PRAME_HUMAN)
LDQLLRHVMNPLETLSITNCR

SEQ ID NO: 344822 - protein, 22 aa, Homo sapiens
  Native (PRAME_HUMAN)
LDQLLRHVMNPLETLSITNCRL

SEQ ID NO: 344823 - protein, 23 aa, Homo sapiens
  Native (PRAME_HUMAN)
LDQLLRHVMNPLETLSITNCRLS

SEQ ID NO: 344824 - protein, 24 aa, Homo sapiens
  Native (PRAME_HUMAN)
LDQLLRHVMNPLETLSITNCRLSE

SEQ ID NO: 344825 - protein, 25 aa, Homo sapiens
  Native (PRAME_HUMAN)
LDQLLRHVMNPLETLSITNCRLSEG

SEQ ID NO: 344826 - protein, 15 aa, Homo sapiens
  Native (PRAME_HUMAN)
LDSIEDLEVTCTWKL

SEQ ID NO: 344827 - protein, 16 aa, Homo sapiens
  Native (PRAME_HUMAN)
LDSIEDLEVTCTWKLP

SEQ ID NO: 344828 - protein, 17 aa, Homo sapiens
  Native (PRAME_HUMAN)
LDSIEDLEVTCTWKLPT

SEQ ID NO: 344829 - protein, 19 aa, Homo sapiens
  Native (PRAME_HUMAN)
LDSIEDLEVTCTWKLPTLA

SEQ ID NO: 344830 - protein, 20 aa, Homo sapiens
  Native (PRAME_HUMAN)
LDSIEDLEVTCTWKLPTLAK

SEQ ID NO: 344831 - protein, 21 aa, Homo sapiens
  Native (PRAME_HUMAN)
LDSIEDLEVTCTWKLPTLAKF

SEQ ID NO: 344832 - protein, 22 aa, Homo sapiens
  Native (PRAME_HUMAN)
LDSIEDLEVTCTWKLPTLAKFS

SEQ ID NO: 344833 - protein, 23 aa, Homo sapiens
  Native (PRAME_HUMAN)
LDSIEDLEVTCTWKLPTLAKFSP

SEQ ID NO: 344834 - protein, 24 aa, Homo sapiens
  Native (PRAME_HUMAN)
LDSIEDLEVTCTWKLPTLAKFSPY

SEQ ID NO: 344835 - protein, 25 aa, Homo sapiens
  Native (PRAME_HUMAN)
LDSIEDLEVTCTWKLPTLAKFSPYL

SEQ ID NO: 344836 - protein, 14 aa, Homo sapiens
  Native (PRAME_HUMAN)
LDVLLAQEVRPRRW

SEQ ID NO: 344837 - protein, 16 aa, Homo sapiens
  Native (PRAME_HUMAN)
LDVLLAQEVRPRRWKL

SEQ ID NO: 344838 - protein, 17 aa, Homo sapiens
  Native (PRAME_HUMAN)
LDVLLAQEVRPRRWKLQ

SEQ ID NO: 344839 - protein, 18 aa, Homo sapiens
  Native (PRAME_HUMAN)
LDVLLAQEVRPRRWKLQV

SEQ ID NO: 344840 - protein, 19 aa, Homo sapiens
  Native (PRAME_HUMAN)
LDVLLAQEVRPRRWKLQVL

SEQ ID NO: 344841 - protein, 20 aa, Homo sapiens
  Native (PRAME_HUMAN)
LDVLLAQEVRPRRWKLQVLD

SEQ ID NO: 344842 - protein, 21 aa, Homo sapiens
  Native (PRAME_HUMAN)
LDVLLAQEVRPRRWKLQVLDL

SEQ ID NO: 344843 - protein, 22 aa, Homo sapiens
  Native (PRAME_HUMAN)
LDVLLAQEVRPRRWKLQVLDLR

SEQ ID NO: 344844 - protein, 23 aa, Homo sapiens
  Native (PRAME_HUMAN)
LDVLLAQEVRPRRWKLQVLDLRK

SEQ ID NO: 344845 - protein, 24 aa, Homo sapiens
  Native (PRAME_HUMAN)
LDVLLAQEVRPRRWKLQVLDLRKN

SEQ ID NO: 344846 - protein, 25 aa, Homo sapiens
  Native (PRAME_HUMAN)
LDVLLAQEVRPRRWKLQVLDLRKNS

SEQ ID NO: 344847 - protein, 14 aa, Homo sapiens
  Native (PRAME_HUMAN)
LELLPRELFPPLFM

SEQ ID NO: 344848 - protein, 15 aa, Homo sapiens
  Native (PRAME_HUMAN)
LELLPRELFPPLFMA

SEQ ID NO: 344849 - protein, 16 aa, Homo sapiens
  Native (PRAME_HUMAN)
LELLPRELFPPLFMAA

SEQ ID NO: 344850 - protein, 17 aa, Homo sapiens
  Native (PRAME_HUMAN)
LELLPRELFPPLFMAAF

SEQ ID NO: 344851 - protein, 18 aa, Homo sapiens
  Native (PRAME_HUMAN)
LELLPRELFPPLFMAAFD

SEQ ID NO: 344852 - protein, 19 aa, Homo sapiens
  Native (PRAME_HUMAN)
LELLPRELFPPLFMAAFDG

SEQ ID NO: 344853 - protein, 20 aa, Homo sapiens
  Native (PRAME_HUMAN)
LELLPRELFPPLFMAAFDGR

SEQ ID NO: 344854 - protein, 21 aa, Homo sapiens
  Native (PRAME_HUMAN)
LELLPRELFPPLFMAAFDGRH

SEQ ID NO: 344855 - protein, 22 aa, Homo sapiens
  Native (PRAME_HUMAN)
LELLPRELFPPLFMAAFDGRHS

SEQ ID NO: 344856 - protein, 23 aa, Homo sapiens
  Native (PRAME_HUMAN)
LELLPRELFPPLFMAAFDGRHSQ

SEQ ID NO: 344857 - protein, 24 aa, Homo sapiens
  Native (PRAME_HUMAN)
LELLPRELFPPLFMAAFDGRHSQT

SEQ ID NO: 344858 - protein, 25 aa, Homo sapiens
  Native (PRAME_HUMAN)
LELLPRELFPPLFMAAFDGRHSQTL

SEQ ID NO: 344859 - protein, 13 aa, Homo sapiens
  Native (PRAME_HUMAN)
LERASATLQDLVF

SEQ ID NO: 344860 - protein, 14 aa, Homo sapiens
  Native (PRAME_HUMAN)
LERASATLQDLVFD

SEQ ID NO: 344861 - protein, 15 aa, Homo sapiens
  Native (PRAME_HUMAN)
LERASATLQDLVFDE

SEQ ID NO: 344862 - protein, 16 aa, Homo sapiens
  Native (PRAME_HUMAN)
LERASATLQDLVFDEC

SEQ ID NO: 344863 - protein, 17 aa, Homo sapiens
  Native (PRAME_HUMAN)
LERASATLQDLVFDECG

SEQ ID NO: 344864 - protein, 18 aa, Homo sapiens
  Native (PRAME_HUMAN)
LERASATLQDLVFDECGI

SEQ ID NO: 344865 - protein, 19 aa, Homo sapiens
  Native (PRAME_HUMAN)
LERASATLQDLVFDECGIT

SEQ ID NO: 344866 - protein, 20 aa, Homo sapiens
  Native (PRAME_HUMAN)
LERASATLQDLVFDECGITD

SEQ ID NO: 344867 - protein, 21 aa, Homo sapiens
  Native (PRAME_HUMAN)
LERASATLQDLVFDECGITDD

SEQ ID NO: 344868 - protein, 22 aa, Homo sapiens
  Native (PRAME_HUMAN)
LERASATLQDLVFDECGITDDQ

SEQ ID NO: 344869 - protein, 23 aa, Homo sapiens
  Native (PRAME_HUMAN)
LERASATLQDLVFDECGITDDQL

SEQ ID NO: 344870 - protein, 24 aa, Homo sapiens
  Native (PRAME_HUMAN)
LERASATLQDLVFDECGITDDQLL

SEQ ID NO: 344871 - protein, 25 aa, Homo sapiens
  Native (PRAME_HUMAN)
LERASATLQDLVFDECGITDDQLLA

SEQ ID NO: 344872 - protein, 13 aa, Homo sapiens
  Native (PRAME_HUMAN)
LERLAYLHARLRE

SEQ ID NO: 344873 - protein, 14 aa, Homo sapiens
  Native (PRAME_HUMAN)
LERLAYLHARLREL

SEQ ID NO: 344874 - protein, 15 aa, Homo sapiens
  Native (PRAME_HUMAN)
LERLAYLHARLRELL

SEQ ID NO: 344875 - protein, 16 aa, Homo sapiens
  Native (PRAME_HUMAN)
LERLAYLHARLRELLC

SEQ ID NO: 344876 - protein, 17 aa, Homo sapiens
  Native (PRAME_HUMAN)
LERLAYLHARLRELLCE

SEQ ID NO: 344877 - protein, 18 aa, Homo sapiens
  Native (PRAME_HUMAN)
LERLAYLHARLRELLCEL

SEQ ID NO: 344878 - protein, 19 aa, Homo sapiens
  Native (PRAME_HUMAN)
LERLAYLHARLRELLCELG

SEQ ID NO: 344879 - protein, 20 aa, Homo sapiens
  Native (PRAME_HUMAN)
LERLAYLHARLRELLCELGR

SEQ ID NO: 344880 - protein, 21 aa, Homo sapiens
  Native (PRAME_HUMAN)
LERLAYLHARLRELLCELGRP

SEQ ID NO: 344881 - protein, 22 aa, Homo sapiens
  Native (PRAME_HUMAN)
LERLAYLHARLRELLCELGRPS

SEQ ID NO: 344882 - protein, 23 aa, Homo sapiens
  Native (PRAME_HUMAN)
LERLAYLHARLRELLCELGRPSM

SEQ ID NO: 344883 - protein, 24 aa, Homo sapiens
  Native (PRAME_HUMAN)
LERLAYLHARLRELLCELGRPSMV

SEQ ID NO: 344884 - protein, 25 aa, Homo sapiens
  Native (PRAME_HUMAN)
LERLAYLHARLRELLCELGRPSMVW

SEQ ID NO: 344885 - protein, 15 aa, Homo sapiens
  Native (PRAME_HUMAN)
LESYEDIHGTLHLER

SEQ ID NO: 344886 - protein, 16 aa, Homo sapiens
  Native (PRAME_HUMAN)
LESYEDIHGTLHLERL

SEQ ID NO: 344887 - protein, 17 aa, Homo sapiens
  Native (PRAME_HUMAN)
LESYEDIHGTLHLERLA

SEQ ID NO: 344888 - protein, 18 aa, Homo sapiens
  Native (PRAME_HUMAN)
LESYEDIHGTLHLERLAY

SEQ ID NO: 344889 - protein, 19 aa, Homo sapiens
  Native (PRAME_HUMAN)
LESYEDIHGTLHLERLAYL

SEQ ID NO: 344890 - protein, 20 aa, Homo sapiens
  Native (PRAME_HUMAN)
LESYEDIHGTLHLERLAYLH

SEQ ID NO: 344891 - protein, 21 aa, Homo sapiens
  Native (PRAME_HUMAN)
LESYEDIHGTLHLERLAYLHA

SEQ ID NO: 344892 - protein, 22 aa, Homo sapiens
  Native (PRAME_HUMAN)
LESYEDIHGTLHLERLAYLHAR

SEQ ID NO: 344893 - protein, 23 aa, Homo sapiens
  Native (PRAME_HUMAN)
LESYEDIHGTLHLERLAYLHARL

SEQ ID NO: 344894 - protein, 24 aa, Homo sapiens
  Native (PRAME_HUMAN)
LESYEDIHGTLHLERLAYLHARLR

SEQ ID NO: 344895 - protein, 25 aa, Homo sapiens
  Native (PRAME_HUMAN)
LESYEDIHGTLHLERLAYLHARLRE

SEQ ID NO: 344896 - protein, 13 aa, Homo sapiens
  Native (PRAME_HUMAN)
LETFKAVLDGLDV

SEQ ID NO: 344897 - protein, 14 aa, Homo sapiens
  Native (PRAME_HUMAN)
LETFKAVLDGLDVL

SEQ ID NO: 344898 - protein, 15 aa, Homo sapiens
  Native (PRAME_HUMAN)
LETFKAVLDGLDVLL

SEQ ID NO: 344899 - protein, 16 aa, Homo sapiens
  Native (PRAME_HUMAN)
LETFKAVLDGLDVLLA

SEQ ID NO: 344900 - protein, 17 aa, Homo sapiens
  Native (PRAME_HUMAN)
LETFKAVLDGLDVLLAQ

SEQ ID NO: 344901 - protein, 18 aa, Homo sapiens
  Native (PRAME_HUMAN)
LETFKAVLDGLDVLLAQE

SEQ ID NO: 344902 - protein, 19 aa, Homo sapiens
  Native (PRAME_HUMAN)
LETFKAVLDGLDVLLAQEV

SEQ ID NO: 344903 - protein, 20 aa, Homo sapiens
  Native (PRAME_HUMAN)
LETFKAVLDGLDVLLAQEVR

SEQ ID NO: 344904 - protein, 21 aa, Homo sapiens
  Native (PRAME_HUMAN)
LETFKAVLDGLDVLLAQEVRP

SEQ ID NO: 344905 - protein, 22 aa, Homo sapiens
  Native (PRAME_HUMAN)
LETFKAVLDGLDVLLAQEVRPR

SEQ ID NO: 344906 - protein, 23 aa, Homo sapiens
  Native (PRAME_HUMAN)
LETFKAVLDGLDVLLAQEVRPRR

SEQ ID NO: 344907 - protein, 24 aa, Homo sapiens
  Native (PRAME_HUMAN)
LETFKAVLDGLDVLLAQEVRPRRW

SEQ ID NO: 344908 - protein, 25 aa, Homo sapiens
  Native (PRAME_HUMAN)
LETFKAVLDGLDVLLAQEVRPRRWK

SEQ ID NO: 344909 - protein, 15 aa, Homo sapiens
  Native (PRAME_HUMAN)
LETLSITNCRLSEGD

SEQ ID NO: 344910 - protein, 16 aa, Homo sapiens
  Native (PRAME_HUMAN)
LETLSITNCRLSEGDV

SEQ ID NO: 344911 - protein, 17 aa, Homo sapiens
  Native (PRAME_HUMAN)
LETLSITNCRLSEGDVM

SEQ ID NO: 344912 - protein, 19 aa, Homo sapiens
  Native (PRAME_HUMAN)
LETLSITNCRLSEGDVMHL

SEQ ID NO: 344913 - protein, 20 aa, Homo sapiens
  Native (PRAME_HUMAN)
LETLSITNCRLSEGDVMHLS

SEQ ID NO: 344914 - protein, 21 aa, Homo sapiens
  Native (PRAME_HUMAN)
LETLSITNCRLSEGDVMHLSQ

SEQ ID NO: 344915 - protein, 22 aa, Homo sapiens
  Native (PRAME_HUMAN)
LETLSITNCRLSEGDVMHLSQS

SEQ ID NO: 344916 - protein, 23 aa, Homo sapiens
  Native (PRAME_HUMAN)
LETLSITNCRLSEGDVMHLSQSP

SEQ ID NO: 344917 - protein, 24 aa, Homo sapiens
  Native (PRAME_HUMAN)
LETLSITNCRLSEGDVMHLSQSPS

SEQ ID NO: 344918 - protein, 25 aa, Homo sapiens
  Native (PRAME_HUMAN)
LETLSITNCRLSEGDVMHLSQSPSV

SEQ ID NO: 344919 - protein, 14 aa, Homo sapiens
  Native (PRAME_HUMAN)
LEVTCTWKLPTLAK

SEQ ID NO: 344920 - protein, 15 aa, Homo sapiens
  Native (PRAME_HUMAN)
LEVTCTWKLPTLAKF

SEQ ID NO: 344921 - protein, 16 aa, Homo sapiens
  Native (PRAME_HUMAN)
LEVTCTWKLPTLAKFS

SEQ ID NO: 344922 - protein, 17 aa, Homo sapiens
  Native (PRAME_HUMAN)
LEVTCTWKLPTLAKFSP

SEQ ID NO: 344923 - protein, 18 aa, Homo sapiens
  Native (PRAME_HUMAN)
LEVTCTWKLPTLAKFSPY

SEQ ID NO: 344924 - protein, 19 aa, Homo sapiens
  Native (PRAME_HUMAN)
LEVTCTWKLPTLAKFSPYL

SEQ ID NO: 344925 - protein, 20 aa, Homo sapiens
  Native (PRAME_HUMAN)
LEVTCTWKLPTLAKFSPYLG

SEQ ID NO: 344926 - protein, 21 aa, Homo sapiens
  Native (PRAME_HUMAN)
LEVTCTWKLPTLAKFSPYLGQ

SEQ ID NO: 344927 - protein, 22 aa, Homo sapiens
  Native (PRAME_HUMAN)
LEVTCTWKLPTLAKFSPYLGQM

SEQ ID NO: 344928 - protein, 23 aa, Homo sapiens
  Native (PRAME_HUMAN)
LEVTCTWKLPTLAKFSPYLGQMI

SEQ ID NO: 344929 - protein, 24 aa, Homo sapiens
  Native (PRAME_HUMAN)
LEVTCTWKLPTLAKFSPYLGQMIN

SEQ ID NO: 344930 - protein, 25 aa, Homo sapiens
  Native (PRAME_HUMAN)
LEVTCTWKLPTLAKFSPYLGQMINL

SEQ ID NO: 344931 - protein, 13 aa, Homo sapiens
  Native (PRAME_HUMAN)
LFFLRGRLDQLLR

SEQ ID NO: 344932 - protein, 14 aa, Homo sapiens
  Native (PRAME_HUMAN)
LFFLRGRLDQLLRH

SEQ ID NO: 344933 - protein, 15 aa, Homo sapiens
  Native (PRAME_HUMAN)
LFFLRGRLDQLLRHV

SEQ ID NO: 344934 - protein, 16 aa, Homo sapiens
  Native (PRAME_HUMAN)
LFFLRGRLDQLLRHVM

SEQ ID NO: 344935 - protein, 17 aa, Homo sapiens
  Native (PRAME_HUMAN)
LFFLRGRLDQLLRHVMN

SEQ ID NO: 344936 - protein, 18 aa, Homo sapiens
  Native (PRAME_HUMAN)
LFFLRGRLDQLLRHVMNP

SEQ ID NO: 344937 - protein, 19 aa, Homo sapiens
  Native (PRAME_HUMAN)
LFFLRGRLDQLLRHVMNPL

SEQ ID NO: 344938 - protein, 20 aa, Homo sapiens
  Native (PRAME_HUMAN)
LFFLRGRLDQLLRHVMNPLE

SEQ ID NO: 344939 - protein, 21 aa, Homo sapiens
  Native (PRAME_HUMAN)
LFFLRGRLDQLLRHVMNPLET

SEQ ID NO: 344940 - protein, 22 aa, Homo sapiens
  Native (PRAME_HUMAN)
LFFLRGRLDQLLRHVMNPLETL

SEQ ID NO: 344941 - protein, 23 aa, Homo sapiens
  Native (PRAME_HUMAN)
LFFLRGRLDQLLRHVMNPLETLS

SEQ ID NO: 344942 - protein, 24 aa, Homo sapiens
  Native (PRAME_HUMAN)
LFFLRGRLDQLLRHVMNPLETLSI

SEQ ID NO: 344943 - protein, 25 aa, Homo sapiens
  Native (PRAME_HUMAN)
LFFLRGRLDQLLRHVMNPLETLSIT

SEQ ID NO: 344944 - protein, 15 aa, Homo sapiens
  Native (PRAME_HUMAN)
LFLKEGACDELFSYL

SEQ ID NO: 344945 - protein, 16 aa, Homo sapiens
  Native (PRAME_HUMAN)
LFLKEGACDELFSYLI

SEQ ID NO: 344946 - protein, 17 aa, Homo sapiens
  Native (PRAME_HUMAN)
LFLKEGACDELFSYLIE

SEQ ID NO: 344947 - protein, 18 aa, Homo sapiens
  Native (PRAME_HUMAN)
LFLKEGACDELFSYLIEK

SEQ ID NO: 344948 - protein, 19 aa, Homo sapiens
  Native (PRAME_HUMAN)
LFLKEGACDELFSYLIEKV

SEQ ID NO: 344949 - protein, 20 aa, Homo sapiens
  Native (PRAME_HUMAN)
LFLKEGACDELFSYLIEKVK

SEQ ID NO: 344950 - protein, 21 aa, Homo sapiens
  Native (PRAME_HUMAN)
LFLKEGACDELFSYLIEKVKR

SEQ ID NO: 344951 - protein, 22 aa, Homo sapiens
  Native (PRAME_HUMAN)
LFLKEGACDELFSYLIEKVKRK

SEQ ID NO: 344952 - protein, 23 aa, Homo sapiens
  Native (PRAME_HUMAN)
LFLKEGACDELFSYLIEKVKRKK

SEQ ID NO: 344953 - protein, 24 aa, Homo sapiens
  Native (PRAME_HUMAN)
LFLKEGACDELFSYLIEKVKRKKN

SEQ ID NO: 344954 - protein, 25 aa, Homo sapiens
  Native (PRAME_HUMAN)
LFLKEGACDELFSYLIEKVKRKKNV

SEQ ID NO: 344955 - protein, 14 aa, Homo sapiens
  Native (PRAME_HUMAN)
LFMAAFDGRHSQTL

SEQ ID NO: 344956 - protein, 15 aa, Homo sapiens
  Native (PRAME_HUMAN)
LFMAAFDGRHSQTLK

SEQ ID NO: 344957 - protein, 16 aa, Homo sapiens
  Native (PRAME_HUMAN)
LFMAAFDGRHSQTLKA

SEQ ID NO: 344958 - protein, 17 aa, Homo sapiens
  Native (PRAME_HUMAN)
LFMAAFDGRHSQTLKAM

SEQ ID NO: 344959 - protein, 18 aa, Homo sapiens
  Native (PRAME_HUMAN)
LFMAAFDGRHSQTLKAMV

SEQ ID NO: 344960 - protein, 19 aa, Homo sapiens
  Native (PRAME_HUMAN)
LFMAAFDGRHSQTLKAMVQ

SEQ ID NO: 344961 - protein, 20 aa, Homo sapiens
  Native (PRAME_HUMAN)
LFMAAFDGRHSQTLKAMVQA

SEQ ID NO: 344962 - protein, 21 aa, Homo sapiens
  Native (PRAME_HUMAN)
LFMAAFDGRHSQTLKAMVQAW

SEQ ID NO: 344963 - protein, 22 aa, Homo sapiens
  Native (PRAME_HUMAN)
LFMAAFDGRHSQTLKAMVQAWP

SEQ ID NO: 344964 - protein, 23 aa, Homo sapiens
  Native (PRAME_HUMAN)
LFMAAFDGRHSQTLKAMVQAWPF

SEQ ID NO: 344965 - protein, 24 aa, Homo sapiens
  Native (PRAME_HUMAN)
LFMAAFDGRHSQTLKAMVQAWPFT

SEQ ID NO: 344966 - protein, 25 aa, Homo sapiens
  Native (PRAME_HUMAN)
LFMAAFDGRHSQTLKAMVQAWPFTC

SEQ ID NO: 344967 - protein, 14 aa, Homo sapiens
  Native (PRAME_HUMAN)
LFPPLFMAAFDGRH

SEQ ID NO: 344968 - protein, 15 aa, Homo sapiens
  Native (PRAME_HUMAN)
LFPPLFMAAFDGRHS

SEQ ID NO: 344969 - protein, 16 aa, Homo sapiens
  Native (PRAME_HUMAN)
LFPPLFMAAFDGRHSQ

SEQ ID NO: 344970 - protein, 17 aa, Homo sapiens
  Native (PRAME_HUMAN)
LFPPLFMAAFDGRHSQT

SEQ ID NO: 344971 - protein, 18 aa, Homo sapiens
  Native (PRAME_HUMAN)
LFPPLFMAAFDGRHSQTL

SEQ ID NO: 344972 - protein, 19 aa, Homo sapiens
  Native (PRAME_HUMAN)
LFPPLFMAAFDGRHSQTLK

SEQ ID NO: 344973 - protein, 20 aa, Homo sapiens
  Native (PRAME_HUMAN)
LFPPLFMAAFDGRHSQTLKA

SEQ ID NO: 344974 - protein, 21 aa, Homo sapiens
  Native (PRAME_HUMAN)
LFPPLFMAAFDGRHSQTLKAM

SEQ ID NO: 344975 - protein, 22 aa, Homo sapiens
  Native (PRAME_HUMAN)
LFPPLFMAAFDGRHSQTLKAMV

SEQ ID NO: 344976 - protein, 23 aa, Homo sapiens
  Native (PRAME_HUMAN)
LFPPLFMAAFDGRHSQTLKAMVQ

SEQ ID NO: 344977 - protein, 24 aa, Homo sapiens
  Native (PRAME_HUMAN)
LFPPLFMAAFDGRHSQTLKAMVQA

SEQ ID NO: 344978 - protein, 25 aa, Homo sapiens
  Native (PRAME_HUMAN)
LFPPLFMAAFDGRHSQTLKAMVQAW

SEQ ID NO: 344979 - protein, 13 aa, Homo sapiens
  Native (PRAME_HUMAN)
LFSYLIEKVKRKK

SEQ ID NO: 344980 - protein, 14 aa, Homo sapiens
  Native (PRAME_HUMAN)
LFSYLIEKVKRKKN

SEQ ID NO: 344981 - protein, 16 aa, Homo sapiens
  Native (PRAME_HUMAN)
LFSYLIEKVKRKKNVL

SEQ ID NO: 344982 - protein, 17 aa, Homo sapiens
  Native (PRAME_HUMAN)
LFSYLIEKVKRKKNVLR

SEQ ID NO: 344983 - protein, 18 aa, Homo sapiens
  Native (PRAME_HUMAN)
LFSYLIEKVKRKKNVLRL

SEQ ID NO: 344984 - protein, 19 aa, Homo sapiens
  Native (PRAME_HUMAN)
LFSYLIEKVKRKKNVLRLC

SEQ ID NO: 344985 - protein, 20 aa, Homo sapiens
  Native (PRAME_HUMAN)
LFSYLIEKVKRKKNVLRLCC

SEQ ID NO: 344986 - protein, 21 aa, Homo sapiens
  Native (PRAME_HUMAN)
LFSYLIEKVKRKKNVLRLCCK

SEQ ID NO: 344987 - protein, 22 aa, Homo sapiens
  Native (PRAME_HUMAN)
LFSYLIEKVKRKKNVLRLCCKK

SEQ ID NO: 344988 - protein, 23 aa, Homo sapiens
  Native (PRAME_HUMAN)
LFSYLIEKVKRKKNVLRLCCKKL

SEQ ID NO: 344989 - protein, 24 aa, Homo sapiens
  Native (PRAME_HUMAN)
LFSYLIEKVKRKKNVLRLCCKKLK

SEQ ID NO: 344990 - protein, 25 aa, Homo sapiens
  Native (PRAME_HUMAN)
LFSYLIEKVKRKKNVLRLCCKKLKI

SEQ ID NO: 344991 - protein, 13 aa, Homo sapiens
  Native (PRAME_HUMAN)
LGQMINLRRLLLS

SEQ ID NO: 344992 - protein, 14 aa, Homo sapiens
  Native (PRAME_HUMAN)
LGQMINLRRLLLSH

SEQ ID NO: 344993 - protein, 16 aa, Homo sapiens
  Native (PRAME_HUMAN)
LGQMINLRRLLLSHIH

SEQ ID NO: 344994 - protein, 17 aa, Homo sapiens
  Native (PRAME_HUMAN)
LGQMINLRRLLLSHIHA

SEQ ID NO: 344995 - protein, 18 aa, Homo sapiens
  Native (PRAME_HUMAN)
LGQMINLRRLLLSHIHAS

SEQ ID NO: 344996 - protein, 19 aa, Homo sapiens
  Native (PRAME_HUMAN)
LGQMINLRRLLLSHIHASS

SEQ ID NO: 344997 - protein, 20 aa, Homo sapiens
  Native (PRAME_HUMAN)
LGQMINLRRLLLSHIHASSY

SEQ ID NO: 344998 - protein, 21 aa, Homo sapiens
  Native (PRAME_HUMAN)
LGQMINLRRLLLSHIHASSYI

SEQ ID NO: 344999 - protein, 22 aa, Homo sapiens
  Native (PRAME_HUMAN)
LGQMINLRRLLLSHIHASSYIS

SEQ ID NO: 345000 - protein, 23 aa, Homo sapiens
  Native (PRAME_HUMAN)
LGQMINLRRLLLSHIHASSYISP

SEQ ID NO: 345001 - protein, 24 aa, Homo sapiens
  Native (PRAME_HUMAN)
LGQMINLRRLLLSHIHASSYISPE

SEQ ID NO: 345002 - protein, 25 aa, Homo sapiens
  Native (PRAME_HUMAN)
LGQMINLRRLLLSHIHASSYISPEK

SEQ ID NO: 345003 - protein, 14 aa, Homo sapiens
  Native (PRAME_HUMAN)
LGRPSMVWLSANPC

SEQ ID NO: 345004 - protein, 15 aa, Homo sapiens
  Native (PRAME_HUMAN)
LGRPSMVWLSANPCP

SEQ ID NO: 345005 - protein, 16 aa, Homo sapiens
  Native (PRAME_HUMAN)
LGRPSMVWLSANPCPH

SEQ ID NO: 345006 - protein, 17 aa, Homo sapiens
  Native (PRAME_HUMAN)
LGRPSMVWLSANPCPHC

SEQ ID NO: 345007 - protein, 18 aa, Homo sapiens
  Native (PRAME_HUMAN)
LGRPSMVWLSANPCPHCG

SEQ ID NO: 345008 - protein, 19 aa, Homo sapiens
  Native (PRAME_HUMAN)
LGRPSMVWLSANPCPHCGD

SEQ ID NO: 345009 - protein, 20 aa, Homo sapiens
  Native (PRAME_HUMAN)
LGRPSMVWLSANPCPHCGDR

SEQ ID NO: 345010 - protein, 21 aa, Homo sapiens
  Native (PRAME_HUMAN)
LGRPSMVWLSANPCPHCGDRT

SEQ ID NO: 345011 - protein, 22 aa, Homo sapiens
  Native (PRAME_HUMAN)
LGRPSMVWLSANPCPHCGDRTF

SEQ ID NO: 345012 - protein, 23 aa, Homo sapiens
  Native (PRAME_HUMAN)
LGRPSMVWLSANPCPHCGDRTFY

SEQ ID NO: 345013 - protein, 24 aa, Homo sapiens
  Native (PRAME_HUMAN)
LGRPSMVWLSANPCPHCGDRTFYD

SEQ ID NO: 345014 - protein, 25 aa, Homo sapiens
  Native (PRAME_HUMAN)
LGRPSMVWLSANPCPHCGDRTFYDP

SEQ ID NO: 345015 - protein, 13 aa, Homo sapiens
  Native (PRAME_HUMAN)
LGVLMKGQHLHLE

SEQ ID NO: 345016 - protein, 14 aa, Homo sapiens
  Native (PRAME_HUMAN)
LGVLMKGQHLHLET

SEQ ID NO: 345017 - protein, 15 aa, Homo sapiens
  Native (PRAME_HUMAN)
LGVLMKGQHLHLETF

SEQ ID NO: 345018 - protein, 16 aa, Homo sapiens
  Native (PRAME_HUMAN)
LGVLMKGQHLHLETFK

SEQ ID NO: 345019 - protein, 17 aa, Homo sapiens
  Native (PRAME_HUMAN)
LGVLMKGQHLHLETFKA

SEQ ID NO: 345020 - protein, 18 aa, Homo sapiens
  Native (PRAME_HUMAN)
LGVLMKGQHLHLETFKAV

SEQ ID NO: 345021 - protein, 19 aa, Homo sapiens
  Native (PRAME_HUMAN)
LGVLMKGQHLHLETFKAVL

SEQ ID NO: 345022 - protein, 20 aa, Homo sapiens
  Native (PRAME_HUMAN)
LGVLMKGQHLHLETFKAVLD

SEQ ID NO: 345023 - protein, 21 aa, Homo sapiens
  Native (PRAME_HUMAN)
LGVLMKGQHLHLETFKAVLDG

SEQ ID NO: 345024 - protein, 22 aa, Homo sapiens
  Native (PRAME_HUMAN)
LGVLMKGQHLHLETFKAVLDGL

SEQ ID NO: 345025 - protein, 23 aa, Homo sapiens
  Native (PRAME_HUMAN)
LGVLMKGQHLHLETFKAVLDGLD

SEQ ID NO: 345026 - protein, 24 aa, Homo sapiens
  Native (PRAME_HUMAN)
LGVLMKGQHLHLETFKAVLDGLDV

SEQ ID NO: 345027 - protein, 25 aa, Homo sapiens
  Native (PRAME_HUMAN)
LGVLMKGQHLHLETFKAVLDGLDVL

SEQ ID NO: 345028 - protein, 14 aa, Homo sapiens
  Native (PRAME_HUMAN)
LHARLRELLCELGR

SEQ ID NO: 345029 - protein, 15 aa, Homo sapiens
  Native (PRAME_HUMAN)
LHARLRELLCELGRP

SEQ ID NO: 345030 - protein, 16 aa, Homo sapiens
  Native (PRAME_HUMAN)
LHARLRELLCELGRPS

SEQ ID NO: 345031 - protein, 17 aa, Homo sapiens
  Native (PRAME_HUMAN)
LHARLRELLCELGRPSM

SEQ ID NO: 345032 - protein, 18 aa, Homo sapiens
  Native (PRAME_HUMAN)
LHARLRELLCELGRPSMV

SEQ ID NO: 345033 - protein, 19 aa, Homo sapiens
  Native (PRAME_HUMAN)
LHARLRELLCELGRPSMVW

SEQ ID NO: 345034 - protein, 20 aa, Homo sapiens
  Native (PRAME_HUMAN)
LHARLRELLCELGRPSMVWL

SEQ ID NO: 345035 - protein, 21 aa, Homo sapiens
  Native (PRAME_HUMAN)
LHARLRELLCELGRPSMVWLS

SEQ ID NO: 345036 - protein, 22 aa, Homo sapiens
  Native (PRAME_HUMAN)
LHARLRELLCELGRPSMVWLSA

SEQ ID NO: 345037 - protein, 23 aa, Homo sapiens
  Native (PRAME_HUMAN)
LHARLRELLCELGRPSMVWLSAN

SEQ ID NO: 345038 - protein, 24 aa, Homo sapiens
  Native (PRAME_HUMAN)
LHARLRELLCELGRPSMVWLSANP

SEQ ID NO: 345039 - protein, 25 aa, Homo sapiens
  Native (PRAME_HUMAN)
LHARLRELLCELGRPSMVWLSANPC

SEQ ID NO: 345040 - protein, 13 aa, Homo sapiens
  Native (PRAME_HUMAN)
LHLERLAYLHARL

SEQ ID NO: 345041 - protein, 14 aa, Homo sapiens
  Native (PRAME_HUMAN)
LHLERLAYLHARLR

SEQ ID NO: 345042 - protein, 15 aa, Homo sapiens
  Native (PRAME_HUMAN)
LHLERLAYLHARLRE

SEQ ID NO: 345043 - protein, 16 aa, Homo sapiens
  Native (PRAME_HUMAN)
LHLERLAYLHARLREL

SEQ ID NO: 345044 - protein, 17 aa, Homo sapiens
  Native (PRAME_HUMAN)
LHLERLAYLHARLRELL

SEQ ID NO: 345045 - protein, 18 aa, Homo sapiens
  Native (PRAME_HUMAN)
LHLERLAYLHARLRELLC

SEQ ID NO: 345046 - protein, 19 aa, Homo sapiens
  Native (PRAME_HUMAN)
LHLERLAYLHARLRELLCE

SEQ ID NO: 345047 - protein, 20 aa, Homo sapiens
  Native (PRAME_HUMAN)
LHLERLAYLHARLRELLCEL

SEQ ID NO: 345048 - protein, 21 aa, Homo sapiens
  Native (PRAME_HUMAN)
LHLERLAYLHARLRELLCELG

SEQ ID NO: 345049 - protein, 22 aa, Homo sapiens
  Native (PRAME_HUMAN)
LHLERLAYLHARLRELLCELGR

SEQ ID NO: 345050 - protein, 23 aa, Homo sapiens
  Native (PRAME_HUMAN)
LHLERLAYLHARLRELLCELGRP

SEQ ID NO: 345051 - protein, 24 aa, Homo sapiens
  Native (PRAME_HUMAN)
LHLERLAYLHARLRELLCELGRPS

SEQ ID NO: 345052 - protein, 25 aa, Homo sapiens
  Native (PRAME_HUMAN)
LHLERLAYLHARLRELLCELGRPSM

SEQ ID NO: 345053 - protein, 13 aa, Homo sapiens
  Native (PRAME_HUMAN)
LHLETFKAVLDGL

SEQ ID NO: 345054 - protein, 14 aa, Homo sapiens
  Native (PRAME_HUMAN)
LHLETFKAVLDGLD

SEQ ID NO: 345055 - protein, 15 aa, Homo sapiens
  Native (PRAME_HUMAN)
LHLETFKAVLDGLDV

SEQ ID NO: 345056 - protein, 16 aa, Homo sapiens
  Native (PRAME_HUMAN)
LHLETFKAVLDGLDVL

SEQ ID NO: 345057 - protein, 17 aa, Homo sapiens
  Native (PRAME_HUMAN)
LHLETFKAVLDGLDVLL

SEQ ID NO: 345058 - protein, 18 aa, Homo sapiens
  Native (PRAME_HUMAN)
LHLETFKAVLDGLDVLLA

SEQ ID NO: 345059 - protein, 19 aa, Homo sapiens
  Native (PRAME_HUMAN)
LHLETFKAVLDGLDVLLAQ

SEQ ID NO: 345060 - protein, 20 aa, Homo sapiens
  Native (PRAME_HUMAN)
LHLETFKAVLDGLDVLLAQE

SEQ ID NO: 345061 - protein, 21 aa, Homo sapiens
  Native (PRAME_HUMAN)
LHLETFKAVLDGLDVLLAQEV

SEQ ID NO: 345062 - protein, 22 aa, Homo sapiens
  Native (PRAME_HUMAN)
LHLETFKAVLDGLDVLLAQEVR

SEQ ID NO: 345063 - protein, 23 aa, Homo sapiens
  Native (PRAME_HUMAN)
LHLETFKAVLDGLDVLLAQEVRP

SEQ ID NO: 345064 - protein, 24 aa, Homo sapiens
  Native (PRAME_HUMAN)
LHLETFKAVLDGLDVLLAQEVRPR

SEQ ID NO: 345065 - protein, 25 aa, Homo sapiens
  Native (PRAME_HUMAN)
LHLETFKAVLDGLDVLLAQEVRPRR

SEQ ID NO: 345066 - protein, 13 aa, Homo sapiens
  Native (PRAME_HUMAN)
LIEKVKRKKNVLR

SEQ ID NO: 345067 - protein, 14 aa, Homo sapiens
  Native (PRAME_HUMAN)
LIEKVKRKKNVLRL

SEQ ID NO: 345068 - protein, 15 aa, Homo sapiens
  Native (PRAME_HUMAN)
LIEKVKRKKNVLRLC

SEQ ID NO: 345069 - protein, 16 aa, Homo sapiens
  Native (PRAME_HUMAN)
LIEKVKRKKNVLRLCC

SEQ ID NO: 345070 - protein, 17 aa, Homo sapiens
  Native (PRAME_HUMAN)
LIEKVKRKKNVLRLCCK

SEQ ID NO: 345071 - protein, 18 aa, Homo sapiens
  Native (PRAME_HUMAN)
LIEKVKRKKNVLRLCCKK

SEQ ID NO: 345072 - protein, 19 aa, Homo sapiens
  Native (PRAME_HUMAN)
LIEKVKRKKNVLRLCCKKL

SEQ ID NO: 345073 - protein, 20 aa, Homo sapiens
  Native (PRAME_HUMAN)
LIEKVKRKKNVLRLCCKKLK

SEQ ID NO: 345074 - protein, 21 aa, Homo sapiens
  Native (PRAME_HUMAN)
LIEKVKRKKNVLRLCCKKLKI

SEQ ID NO: 345075 - protein, 22 aa, Homo sapiens
  Native (PRAME_HUMAN)
LIEKVKRKKNVLRLCCKKLKIF

SEQ ID NO: 345076 - protein, 23 aa, Homo sapiens
  Native (PRAME_HUMAN)
LIEKVKRKKNVLRLCCKKLKIFA

SEQ ID NO: 345077 - protein, 24 aa, Homo sapiens
  Native (PRAME_HUMAN)
LIEKVKRKKNVLRLCCKKLKIFAM

SEQ ID NO: 345078 - protein, 25 aa, Homo sapiens
  Native (PRAME_HUMAN)
LIEKVKRKKNVLRLCCKKLKIFAMP

SEQ ID NO: 345079 - protein, 13 aa, Homo sapiens
  Native (PRAME_HUMAN)
LIGLSNLTHVLYP

SEQ ID NO: 345080 - protein, 14 aa, Homo sapiens
  Native (PRAME_HUMAN)
LIGLSNLTHVLYPV

SEQ ID NO: 345081 - protein, 15 aa, Homo sapiens
  Native (PRAME_HUMAN)
LIGLSNLTHVLYPVP

SEQ ID NO: 345082 - protein, 16 aa, Homo sapiens
  Native (PRAME_HUMAN)
LIGLSNLTHVLYPVPL

SEQ ID NO: 345083 - protein, 17 aa, Homo sapiens
  Native (PRAME_HUMAN)
LIGLSNLTHVLYPVPLE

SEQ ID NO: 345084 - protein, 18 aa, Homo sapiens
  Native (PRAME_HUMAN)
LIGLSNLTHVLYPVPLES

SEQ ID NO: 345085 - protein, 19 aa, Homo sapiens
  Native (PRAME_HUMAN)
LIGLSNLTHVLYPVPLESY

SEQ ID NO: 345086 - protein, 20 aa, Homo sapiens
  Native (PRAME_HUMAN)
LIGLSNLTHVLYPVPLESYE

SEQ ID NO: 345087 - protein, 21 aa, Homo sapiens
  Native (PRAME_HUMAN)
LIGLSNLTHVLYPVPLESYED

SEQ ID NO: 345088 - protein, 22 aa, Homo sapiens
  Native (PRAME_HUMAN)
LIGLSNLTHVLYPVPLESYEDI

SEQ ID NO: 345089 - protein, 23 aa, Homo sapiens
  Native (PRAME_HUMAN)
LIGLSNLTHVLYPVPLESYEDIH

SEQ ID NO: 345090 - protein, 24 aa, Homo sapiens
  Native (PRAME_HUMAN)
LIGLSNLTHVLYPVPLESYEDIHG

SEQ ID NO: 345091 - protein, 25 aa, Homo sapiens
  Native (PRAME_HUMAN)
LIGLSNLTHVLYPVPLESYEDIHGT

SEQ ID NO: 345092 - protein, 13 aa, Homo sapiens
  Native (PRAME_HUMAN)
LKAMVQAWPFTCL

SEQ ID NO: 345093 - protein, 14 aa, Homo sapiens
  Native (PRAME_HUMAN)
LKAMVQAWPFTCLP

SEQ ID NO: 345094 - protein, 16 aa, Homo sapiens
  Native (PRAME_HUMAN)
LKAMVQAWPFTCLPLG

SEQ ID NO: 345095 - protein, 17 aa, Homo sapiens
  Native (PRAME_HUMAN)
LKAMVQAWPFTCLPLGV

SEQ ID NO: 345096 - protein, 18 aa, Homo sapiens
  Native (PRAME_HUMAN)
LKAMVQAWPFTCLPLGVL

SEQ ID NO: 345097 - protein, 19 aa, Homo sapiens
  Native (PRAME_HUMAN)
LKAMVQAWPFTCLPLGVLM

SEQ ID NO: 345098 - protein, 20 aa, Homo sapiens
  Native (PRAME_HUMAN)
LKAMVQAWPFTCLPLGVLMK

SEQ ID NO: 345099 - protein, 21 aa, Homo sapiens
  Native (PRAME_HUMAN)
LKAMVQAWPFTCLPLGVLMKG

SEQ ID NO: 345100 - protein, 22 aa, Homo sapiens
  Native (PRAME_HUMAN)
LKAMVQAWPFTCLPLGVLMKGQ

SEQ ID NO: 345101 - protein, 23 aa, Homo sapiens
  Native (PRAME_HUMAN)
LKAMVQAWPFTCLPLGVLMKGQH

SEQ ID NO: 345102 - protein, 24 aa, Homo sapiens
  Native (PRAME_HUMAN)
LKAMVQAWPFTCLPLGVLMKGQHL

SEQ ID NO: 345103 - protein, 25 aa, Homo sapiens
  Native (PRAME_HUMAN)
LKAMVQAWPFTCLPLGVLMKGQHLH

SEQ ID NO: 345104 - protein, 13 aa, Homo sapiens
  Native (PRAME_HUMAN)
LKDEALAIAALEL

SEQ ID NO: 345105 - protein, 14 aa, Homo sapiens
  Native (PRAME_HUMAN)
LKDEALAIAALELL

SEQ ID NO: 345106 - protein, 15 aa, Homo sapiens
  Native (PRAME_HUMAN)
LKDEALAIAALELLP

SEQ ID NO: 345107 - protein, 16 aa, Homo sapiens
  Native (PRAME_HUMAN)
LKDEALAIAALELLPR

SEQ ID NO: 345108 - protein, 17 aa, Homo sapiens
  Native (PRAME_HUMAN)
LKDEALAIAALELLPRE

SEQ ID NO: 345109 - protein, 18 aa, Homo sapiens
  Native (PRAME_HUMAN)
LKDEALAIAALELLPREL

SEQ ID NO: 345110 - protein, 19 aa, Homo sapiens
  Native (PRAME_HUMAN)
LKDEALAIAALELLPRELF

SEQ ID NO: 345111 - protein, 20 aa, Homo sapiens
  Native (PRAME_HUMAN)
LKDEALAIAALELLPRELFP

SEQ ID NO: 345112 - protein, 21 aa, Homo sapiens
  Native (PRAME_HUMAN)
LKDEALAIAALELLPRELFPP

SEQ ID NO: 345113 - protein, 22 aa, Homo sapiens
  Native (PRAME_HUMAN)
LKDEALAIAALELLPRELFPPL

SEQ ID NO: 345114 - protein, 23 aa, Homo sapiens
  Native (PRAME_HUMAN)
LKDEALAIAALELLPRELFPPLF

SEQ ID NO: 345115 - protein, 24 aa, Homo sapiens
  Native (PRAME_HUMAN)
LKDEALAIAALELLPRELFPPLFM

SEQ ID NO: 345116 - protein, 25 aa, Homo sapiens
  Native (PRAME_HUMAN)
LKDEALAIAALELLPRELFPPLFMA

SEQ ID NO: 345117 - protein, 15 aa, Homo sapiens
  Native (PRAME_HUMAN)
LKEGACDELFSYLIE

SEQ ID NO: 345118 - protein, 16 aa, Homo sapiens
  Native (PRAME_HUMAN)
LKEGACDELFSYLIEK

SEQ ID NO: 345119 - protein, 17 aa, Homo sapiens
  Native (PRAME_HUMAN)
LKEGACDELFSYLIEKV

SEQ ID NO: 345120 - protein, 18 aa, Homo sapiens
  Native (PRAME_HUMAN)
LKEGACDELFSYLIEKVK

SEQ ID NO: 345121 - protein, 19 aa, Homo sapiens
  Native (PRAME_HUMAN)
LKEGACDELFSYLIEKVKR

SEQ ID NO: 345122 - protein, 20 aa, Homo sapiens
  Native (PRAME_HUMAN)
LKEGACDELFSYLIEKVKRK

SEQ ID NO: 345123 - protein, 21 aa, Homo sapiens
  Native (PRAME_HUMAN)
LKEGACDELFSYLIEKVKRKK

SEQ ID NO: 345124 - protein, 22 aa, Homo sapiens
  Native (PRAME_HUMAN)
LKEGACDELFSYLIEKVKRKKN

SEQ ID NO: 345125 - protein, 23 aa, Homo sapiens
  Native (PRAME_HUMAN)
LKEGACDELFSYLIEKVKRKKNV

SEQ ID NO: 345126 - protein, 24 aa, Homo sapiens
  Native (PRAME_HUMAN)
LKEGACDELFSYLIEKVKRKKNVL

SEQ ID NO: 345127 - protein, 25 aa, Homo sapiens
  Native (PRAME_HUMAN)
LKEGACDELFSYLIEKVKRKKNVLR

SEQ ID NO: 345128 - protein, 13 aa, Homo sapiens
  Native (PRAME_HUMAN)
LKIFAMPMQDIKM

SEQ ID NO: 345129 - protein, 14 aa, Homo sapiens
  Native (PRAME_HUMAN)
LKIFAMPMQDIKMI

SEQ ID NO: 345130 - protein, 15 aa, Homo sapiens
  Native (PRAME_HUMAN)
LKIFAMPMQDIKMIL

SEQ ID NO: 345131 - protein, 16 aa, Homo sapiens
  Native (PRAME_HUMAN)
LKIFAMPMQDIKMILK

SEQ ID NO: 345132 - protein, 17 aa, Homo sapiens
  Native (PRAME_HUMAN)
LKIFAMPMQDIKMILKM

SEQ ID NO: 345133 - protein, 18 aa, Homo sapiens
  Native (PRAME_HUMAN)
LKIFAMPMQDIKMILKMV

SEQ ID NO: 345134 - protein, 19 aa, Homo sapiens
  Native (PRAME_HUMAN)
LKIFAMPMQDIKMILKMVQ

SEQ ID NO: 345135 - protein, 20 aa, Homo sapiens
  Native (PRAME_HUMAN)
LKIFAMPMQDIKMILKMVQL

SEQ ID NO: 345136 - protein, 21 aa, Homo sapiens
  Native (PRAME_HUMAN)
LKIFAMPMQDIKMILKMVQLD

SEQ ID NO: 345137 - protein, 22 aa, Homo sapiens
  Native (PRAME_HUMAN)
LKIFAMPMQDIKMILKMVQLDS

SEQ ID NO: 345138 - protein, 23 aa, Homo sapiens
  Native (PRAME_HUMAN)
LKIFAMPMQDIKMILKMVQLDSI

SEQ ID NO: 345139 - protein, 24 aa, Homo sapiens
  Native (PRAME_HUMAN)
LKIFAMPMQDIKMILKMVQLDSIE

SEQ ID NO: 345140 - protein, 25 aa, Homo sapiens
  Native (PRAME_HUMAN)
LKIFAMPMQDIKMILKMVQLDSIED

SEQ ID NO: 345141 - protein, 13 aa, Homo sapiens
  Native (PRAME_HUMAN)
LKMVQLDSIEDLE

SEQ ID NO: 345142 - protein, 14 aa, Homo sapiens
  Native (PRAME_HUMAN)
LKMVQLDSIEDLEV

SEQ ID NO: 345143 - protein, 15 aa, Homo sapiens
  Native (PRAME_HUMAN)
LKMVQLDSIEDLEVT

SEQ ID NO: 345144 - protein, 16 aa, Homo sapiens
  Native (PRAME_HUMAN)
LKMVQLDSIEDLEVTC

SEQ ID NO: 345145 - protein, 17 aa, Homo sapiens
  Native (PRAME_HUMAN)
LKMVQLDSIEDLEVTCT

SEQ ID NO: 345146 - protein, 18 aa, Homo sapiens
  Native (PRAME_HUMAN)
LKMVQLDSIEDLEVTCTW

SEQ ID NO: 345147 - protein, 19 aa, Homo sapiens
  Native (PRAME_HUMAN)
LKMVQLDSIEDLEVTCTWK

SEQ ID NO: 345148 - protein, 20 aa, Homo sapiens
  Native (PRAME_HUMAN)
LKMVQLDSIEDLEVTCTWKL

SEQ ID NO: 345149 - protein, 21 aa, Homo sapiens
  Native (PRAME_HUMAN)
LKMVQLDSIEDLEVTCTWKLP

SEQ ID NO: 345150 - protein, 22 aa, Homo sapiens
  Native (PRAME_HUMAN)
LKMVQLDSIEDLEVTCTWKLPT

SEQ ID NO: 345151 - protein, 23 aa, Homo sapiens
  Native (PRAME_HUMAN)
LKMVQLDSIEDLEVTCTWKLPTL

SEQ ID NO: 345152 - protein, 24 aa, Homo sapiens
  Native (PRAME_HUMAN)
LKMVQLDSIEDLEVTCTWKLPTLA

SEQ ID NO: 345153 - protein, 25 aa, Homo sapiens
  Native (PRAME_HUMAN)
LKMVQLDSIEDLEVTCTWKLPTLAK

SEQ ID NO: 345154 - protein, 13 aa, Homo sapiens
  Native (PRAME_HUMAN)
LLALLPSLSHCSQ

SEQ ID NO: 345155 - protein, 14 aa, Homo sapiens
  Native (PRAME_HUMAN)
LLALLPSLSHCSQL

SEQ ID NO: 345156 - protein, 15 aa, Homo sapiens
  Native (PRAME_HUMAN)
LLALLPSLSHCSQLT

SEQ ID NO: 345157 - protein, 16 aa, Homo sapiens
  Native (PRAME_HUMAN)
LLALLPSLSHCSQLTT

SEQ ID NO: 345158 - protein, 17 aa, Homo sapiens
  Native (PRAME_HUMAN)
LLALLPSLSHCSQLTTL

SEQ ID NO: 345159 - protein, 18 aa, Homo sapiens
  Native (PRAME_HUMAN)
LLALLPSLSHCSQLTTLS

SEQ ID NO: 345160 - protein, 19 aa, Homo sapiens
  Native (PRAME_HUMAN)
LLALLPSLSHCSQLTTLSF

SEQ ID NO: 345161 - protein, 20 aa, Homo sapiens
  Native (PRAME_HUMAN)
LLALLPSLSHCSQLTTLSFY

SEQ ID NO: 345162 - protein, 21 aa, Homo sapiens
  Native (PRAME_HUMAN)
LLALLPSLSHCSQLTTLSFYG

SEQ ID NO: 345163 - protein, 22 aa, Homo sapiens
  Native (PRAME_HUMAN)
LLALLPSLSHCSQLTTLSFYGN

SEQ ID NO: 345164 - protein, 23 aa, Homo sapiens
  Native (PRAME_HUMAN)
LLALLPSLSHCSQLTTLSFYGNS

SEQ ID NO: 345165 - protein, 24 aa, Homo sapiens
  Native (PRAME_HUMAN)
LLALLPSLSHCSQLTTLSFYGNSI

SEQ ID NO: 345166 - protein, 25 aa, Homo sapiens
  Native (PRAME_HUMAN)
LLALLPSLSHCSQLTTLSFYGNSIS

SEQ ID NO: 345167 - protein, 14 aa, Homo sapiens
  Native (PRAME_HUMAN)
LLAQEVRPRRWKLQ

SEQ ID NO: 345168 - protein, 15 aa, Homo sapiens
  Native (PRAME_HUMAN)
LLAQEVRPRRWKLQV

SEQ ID NO: 345169 - protein, 16 aa, Homo sapiens
  Native (PRAME_HUMAN)
LLAQEVRPRRWKLQVL

SEQ ID NO: 345170 - protein, 17 aa, Homo sapiens
  Native (PRAME_HUMAN)
LLAQEVRPRRWKLQVLD

SEQ ID NO: 345171 - protein, 18 aa, Homo sapiens
  Native (PRAME_HUMAN)
LLAQEVRPRRWKLQVLDL

SEQ ID NO: 345172 - protein, 19 aa, Homo sapiens
  Native (PRAME_HUMAN)
LLAQEVRPRRWKLQVLDLR

SEQ ID NO: 345173 - protein, 20 aa, Homo sapiens
  Native (PRAME_HUMAN)
LLAQEVRPRRWKLQVLDLRK

SEQ ID NO: 345174 - protein, 21 aa, Homo sapiens
  Native (PRAME_HUMAN)
LLAQEVRPRRWKLQVLDLRKN

SEQ ID NO: 345175 - protein, 22 aa, Homo sapiens
  Native (PRAME_HUMAN)
LLAQEVRPRRWKLQVLDLRKNS

SEQ ID NO: 345176 - protein, 23 aa, Homo sapiens
  Native (PRAME_HUMAN)
LLAQEVRPRRWKLQVLDLRKNSH

SEQ ID NO: 345177 - protein, 24 aa, Homo sapiens
  Native (PRAME_HUMAN)
LLAQEVRPRRWKLQVLDLRKNSHQ

SEQ ID NO: 345178 - protein, 25 aa, Homo sapiens
  Native (PRAME_HUMAN)
LLAQEVRPRRWKLQVLDLRKNSHQD

SEQ ID NO: 345179 - protein, 14 aa, Homo sapiens
  Native (PRAME_HUMAN)
LLCELGRPSMVWLS

SEQ ID NO: 345180 - protein, 15 aa, Homo sapiens
  Native (PRAME_HUMAN)
LLCELGRPSMVWLSA

SEQ ID NO: 345181 - protein, 16 aa, Homo sapiens
  Native (PRAME_HUMAN)
LLCELGRPSMVWLSAN

SEQ ID NO: 345182 - protein, 17 aa, Homo sapiens
  Native (PRAME_HUMAN)
LLCELGRPSMVWLSANP

SEQ ID NO: 345183 - protein, 18 aa, Homo sapiens
  Native (PRAME_HUMAN)
LLCELGRPSMVWLSANPC

SEQ ID NO: 345184 - protein, 19 aa, Homo sapiens
  Native (PRAME_HUMAN)
LLCELGRPSMVWLSANPCP

SEQ ID NO: 345185 - protein, 20 aa, Homo sapiens
  Native (PRAME_HUMAN)
LLCELGRPSMVWLSANPCPH

SEQ ID NO: 345186 - protein, 21 aa, Homo sapiens
  Native (PRAME_HUMAN)
LLCELGRPSMVWLSANPCPHC

SEQ ID NO: 345187 - protein, 22 aa, Homo sapiens
  Native (PRAME_HUMAN)
LLCELGRPSMVWLSANPCPHCG

SEQ ID NO: 345188 - protein, 23 aa, Homo sapiens
  Native (PRAME_HUMAN)
LLCELGRPSMVWLSANPCPHCGD

SEQ ID NO: 345189 - protein, 24 aa, Homo sapiens
  Native (PRAME_HUMAN)
LLCELGRPSMVWLSANPCPHCGDR

SEQ ID NO: 345190 - protein, 25 aa, Homo sapiens
  Native (PRAME_HUMAN)
LLCELGRPSMVWLSANPCPHCGDRT

SEQ ID NO: 345191 - protein, 13 aa, Homo sapiens
  Native (PRAME_HUMAN)
LLERASATLQDLV

SEQ ID NO: 345192 - protein, 14 aa, Homo sapiens
  Native (PRAME_HUMAN)
LLERASATLQDLVF

SEQ ID NO: 345193 - protein, 15 aa, Homo sapiens
  Native (PRAME_HUMAN)
LLERASATLQDLVFD

SEQ ID NO: 345194 - protein, 16 aa, Homo sapiens
  Native (PRAME_HUMAN)
LLERASATLQDLVFDE

SEQ ID NO: 345195 - protein, 17 aa, Homo sapiens
  Native (PRAME_HUMAN)
LLERASATLQDLVFDEC

SEQ ID NO: 345196 - protein, 18 aa, Homo sapiens
  Native (PRAME_HUMAN)
LLERASATLQDLVFDECG

SEQ ID NO: 345197 - protein, 19 aa, Homo sapiens
  Native (PRAME_HUMAN)
LLERASATLQDLVFDECGI

SEQ ID NO: 345198 - protein, 20 aa, Homo sapiens
  Native (PRAME_HUMAN)
LLERASATLQDLVFDECGIT

SEQ ID NO: 345199 - protein, 21 aa, Homo sapiens
  Native (PRAME_HUMAN)
LLERASATLQDLVFDECGITD

SEQ ID NO: 345200 - protein, 22 aa, Homo sapiens
  Native (PRAME_HUMAN)
LLERASATLQDLVFDECGITDD

SEQ ID NO: 345201 - protein, 23 aa, Homo sapiens
  Native (PRAME_HUMAN)
LLERASATLQDLVFDECGITDDQ

SEQ ID NO: 345202 - protein, 24 aa, Homo sapiens
  Native (PRAME_HUMAN)
LLERASATLQDLVFDECGITDDQL

SEQ ID NO: 345203 - protein, 25 aa, Homo sapiens
  Native (PRAME_HUMAN)
LLERASATLQDLVFDECGITDDQLL

SEQ ID NO: 345204 - protein, 13 aa, Homo sapiens
  Native (PRAME_HUMAN)
LLKDEALAIAALE

SEQ ID NO: 345205 - protein, 14 aa, Homo sapiens
  Native (PRAME_HUMAN)
LLKDEALAIAALEL

SEQ ID NO: 345206 - protein, 15 aa, Homo sapiens
  Native (PRAME_HUMAN)
LLKDEALAIAALELL

SEQ ID NO: 345207 - protein, 16 aa, Homo sapiens
  Native (PRAME_HUMAN)
LLKDEALAIAALELLP

SEQ ID NO: 345208 - protein, 17 aa, Homo sapiens
  Native (PRAME_HUMAN)
LLKDEALAIAALELLPR

SEQ ID NO: 345209 - protein, 18 aa, Homo sapiens
  Native (PRAME_HUMAN)
LLKDEALAIAALELLPRE

SEQ ID NO: 345210 - protein, 19 aa, Homo sapiens
  Native (PRAME_HUMAN)
LLKDEALAIAALELLPREL

SEQ ID NO: 345211 - protein, 20 aa, Homo sapiens
  Native (PRAME_HUMAN)
LLKDEALAIAALELLPRELF

SEQ ID NO: 345212 - protein, 21 aa, Homo sapiens
  Native (PRAME_HUMAN)
LLKDEALAIAALELLPRELFP

SEQ ID NO: 345213 - protein, 22 aa, Homo sapiens
  Native (PRAME_HUMAN)
LLKDEALAIAALELLPRELFPP

SEQ ID NO: 345214 - protein, 23 aa, Homo sapiens
  Native (PRAME_HUMAN)
LLKDEALAIAALELLPRELFPPL

SEQ ID NO: 345215 - protein, 24 aa, Homo sapiens
  Native (PRAME_HUMAN)
LLKDEALAIAALELLPRELFPPLF

SEQ ID NO: 345216 - protein, 25 aa, Homo sapiens
  Native (PRAME_HUMAN)
LLKDEALAIAALELLPRELFPPLFM

SEQ ID NO: 345217 - protein, 13 aa, Homo sapiens
  Native (PRAME_HUMAN)
LLLSHIHASSYIS

SEQ ID NO: 345218 - protein, 14 aa, Homo sapiens
  Native (PRAME_HUMAN)
LLLSHIHASSYISP

SEQ ID NO: 345219 - protein, 15 aa, Homo sapiens
  Native (PRAME_HUMAN)
LLLSHIHASSYISPE

SEQ ID NO: 345220 - protein, 16 aa, Homo sapiens
  Native (PRAME_HUMAN)
LLLSHIHASSYISPEK

SEQ ID NO: 345221 - protein, 17 aa, Homo sapiens
  Native (PRAME_HUMAN)
LLLSHIHASSYISPEKE

SEQ ID NO: 345222 - protein, 18 aa, Homo sapiens
  Native (PRAME_HUMAN)
LLLSHIHASSYISPEKEE

SEQ ID NO: 345223 - protein, 19 aa, Homo sapiens
  Native (PRAME_HUMAN)
LLLSHIHASSYISPEKEEQ

SEQ ID NO: 345224 - protein, 20 aa, Homo sapiens
  Native (PRAME_HUMAN)
LLLSHIHASSYISPEKEEQY

SEQ ID NO: 345225 - protein, 21 aa, Homo sapiens
  Native (PRAME_HUMAN)
LLLSHIHASSYISPEKEEQYI

SEQ ID NO: 345226 - protein, 22 aa, Homo sapiens
  Native (PRAME_HUMAN)
LLLSHIHASSYISPEKEEQYIA

SEQ ID NO: 345227 - protein, 23 aa, Homo sapiens
  Native (PRAME_HUMAN)
LLLSHIHASSYISPEKEEQYIAQ

SEQ ID NO: 345228 - protein, 24 aa, Homo sapiens
  Native (PRAME_HUMAN)
LLLSHIHASSYISPEKEEQYIAQF

SEQ ID NO: 345229 - protein, 25 aa, Homo sapiens
  Native (PRAME_HUMAN)
LLLSHIHASSYISPEKEEQYIAQFT

SEQ ID NO: 345230 - protein, 13 aa, Homo sapiens
  Native (PRAME_HUMAN)
LLPRELFPPLFMA

SEQ ID NO: 345231 - protein, 14 aa, Homo sapiens
  Native (PRAME_HUMAN)
LLPRELFPPLFMAA

SEQ ID NO: 345232 - protein, 15 aa, Homo sapiens
  Native (PRAME_HUMAN)
LLPRELFPPLFMAAF

SEQ ID NO: 345233 - protein, 16 aa, Homo sapiens
  Native (PRAME_HUMAN)
LLPRELFPPLFMAAFD

SEQ ID NO: 345234 - protein, 17 aa, Homo sapiens
  Native (PRAME_HUMAN)
LLPRELFPPLFMAAFDG

SEQ ID NO: 345235 - protein, 18 aa, Homo sapiens
  Native (PRAME_HUMAN)
LLPRELFPPLFMAAFDGR

SEQ ID NO: 345236 - protein, 19 aa, Homo sapiens
  Native (PRAME_HUMAN)
LLPRELFPPLFMAAFDGRH

SEQ ID NO: 345237 - protein, 20 aa, Homo sapiens
  Native (PRAME_HUMAN)
LLPRELFPPLFMAAFDGRHS

SEQ ID NO: 345238 - protein, 21 aa, Homo sapiens
  Native (PRAME_HUMAN)
LLPRELFPPLFMAAFDGRHSQ

SEQ ID NO: 345239 - protein, 22 aa, Homo sapiens
  Native (PRAME_HUMAN)
LLPRELFPPLFMAAFDGRHSQT

SEQ ID NO: 345240 - protein, 23 aa, Homo sapiens
  Native (PRAME_HUMAN)
LLPRELFPPLFMAAFDGRHSQTL

SEQ ID NO: 345241 - protein, 24 aa, Homo sapiens
  Native (PRAME_HUMAN)
LLPRELFPPLFMAAFDGRHSQTLK

SEQ ID NO: 345242 - protein, 25 aa, Homo sapiens
  Native (PRAME_HUMAN)
LLPRELFPPLFMAAFDGRHSQTLKA

SEQ ID NO: 345243 - protein, 15 aa, Homo sapiens
  Native (PRAME_HUMAN)
LLPSLSHCSQLTTLS

SEQ ID NO: 345244 - protein, 16 aa, Homo sapiens
  Native (PRAME_HUMAN)
LLPSLSHCSQLTTLSF

SEQ ID NO: 345245 - protein, 17 aa, Homo sapiens
  Native (PRAME_HUMAN)
LLPSLSHCSQLTTLSFY

SEQ ID NO: 345246 - protein, 19 aa, Homo sapiens
  Native (PRAME_HUMAN)
LLPSLSHCSQLTTLSFYGN

SEQ ID NO: 345247 - protein, 20 aa, Homo sapiens
  Native (PRAME_HUMAN)
LLPSLSHCSQLTTLSFYGNS

SEQ ID NO: 345248 - protein, 21 aa, Homo sapiens
  Native (PRAME_HUMAN)
LLPSLSHCSQLTTLSFYGNSI

SEQ ID NO: 345249 - protein, 22 aa, Homo sapiens
  Native (PRAME_HUMAN)
LLPSLSHCSQLTTLSFYGNSIS

SEQ ID NO: 345250 - protein, 23 aa, Homo sapiens
  Native (PRAME_HUMAN)
LLPSLSHCSQLTTLSFYGNSISI

SEQ ID NO: 345251 - protein, 24 aa, Homo sapiens
  Native (PRAME_HUMAN)
LLPSLSHCSQLTTLSFYGNSISIS

SEQ ID NO: 345252 - protein, 25 aa, Homo sapiens
  Native (PRAME_HUMAN)
LLPSLSHCSQLTTLSFYGNSISISA

SEQ ID NO: 345253 - protein, 13 aa, Homo sapiens
  Native (PRAME_HUMAN)
LLQHLIGLSNLTH

SEQ ID NO: 345254 - protein, 14 aa, Homo sapiens
  Native (PRAME_HUMAN)
LLQHLIGLSNLTHV

SEQ ID NO: 345255 - protein, 15 aa, Homo sapiens
  Native (PRAME_HUMAN)
LLQHLIGLSNLTHVL

SEQ ID NO: 345256 - protein, 16 aa, Homo sapiens
  Native (PRAME_HUMAN)
LLQHLIGLSNLTHVLY

SEQ ID NO: 345257 - protein, 17 aa, Homo sapiens
  Native (PRAME_HUMAN)
LLQHLIGLSNLTHVLYP

SEQ ID NO: 345258 - protein, 18 aa, Homo sapiens
  Native (PRAME_HUMAN)
LLQHLIGLSNLTHVLYPV

SEQ ID NO: 345259 - protein, 19 aa, Homo sapiens
  Native (PRAME_HUMAN)
LLQHLIGLSNLTHVLYPVP

SEQ ID NO: 345260 - protein, 20 aa, Homo sapiens
  Native (PRAME_HUMAN)
LLQHLIGLSNLTHVLYPVPL

SEQ ID NO: 345261 - protein, 21 aa, Homo sapiens
  Native (PRAME_HUMAN)
LLQHLIGLSNLTHVLYPVPLE

SEQ ID NO: 345262 - protein, 22 aa, Homo sapiens
  Native (PRAME_HUMAN)
LLQHLIGLSNLTHVLYPVPLES

SEQ ID NO: 345263 - protein, 23 aa, Homo sapiens
  Native (PRAME_HUMAN)
LLQHLIGLSNLTHVLYPVPLESY

SEQ ID NO: 345264 - protein, 24 aa, Homo sapiens
  Native (PRAME_HUMAN)
LLQHLIGLSNLTHVLYPVPLESYE

SEQ ID NO: 345265 - protein, 25 aa, Homo sapiens
  Native (PRAME_HUMAN)
LLQHLIGLSNLTHVLYPVPLESYED

SEQ ID NO: 345266 - protein, 13 aa, Homo sapiens
  Native (PRAME_HUMAN)
LLRHVMNPLETLS

SEQ ID NO: 345267 - protein, 14 aa, Homo sapiens
  Native (PRAME_HUMAN)
LLRHVMNPLETLSI

SEQ ID NO: 345268 - protein, 15 aa, Homo sapiens
  Native (PRAME_HUMAN)
LLRHVMNPLETLSIT

SEQ ID NO: 345269 - protein, 16 aa, Homo sapiens
  Native (PRAME_HUMAN)
LLRHVMNPLETLSITN

SEQ ID NO: 345270 - protein, 17 aa, Homo sapiens
  Native (PRAME_HUMAN)
LLRHVMNPLETLSITNC

SEQ ID NO: 345271 - protein, 18 aa, Homo sapiens
  Native (PRAME_HUMAN)
LLRHVMNPLETLSITNCR

SEQ ID NO: 345272 - protein, 19 aa, Homo sapiens
  Native (PRAME_HUMAN)
LLRHVMNPLETLSITNCRL

SEQ ID NO: 345273 - protein, 20 aa, Homo sapiens
  Native (PRAME_HUMAN)
LLRHVMNPLETLSITNCRLS

SEQ ID NO: 345274 - protein, 21 aa, Homo sapiens
  Native (PRAME_HUMAN)
LLRHVMNPLETLSITNCRLSE

SEQ ID NO: 345275 - protein, 22 aa, Homo sapiens
  Native (PRAME_HUMAN)
LLRHVMNPLETLSITNCRLSEG

SEQ ID NO: 345276 - protein, 23 aa, Homo sapiens
  Native (PRAME_HUMAN)
LLRHVMNPLETLSITNCRLSEGD

SEQ ID NO: 345277 - protein, 24 aa, Homo sapiens
  Native (PRAME_HUMAN)
LLRHVMNPLETLSITNCRLSEGDV

SEQ ID NO: 345278 - protein, 25 aa, Homo sapiens
  Native (PRAME_HUMAN)
LLRHVMNPLETLSITNCRLSEGDVM

SEQ ID NO: 345279 - protein, 14 aa, Homo sapiens
  Native (PRAME_HUMAN)
LLSHIHASSYISPE

SEQ ID NO: 345280 - protein, 15 aa, Homo sapiens
  Native (PRAME_HUMAN)
LLSHIHASSYISPEK

SEQ ID NO: 345281 - protein, 16 aa, Homo sapiens
  Native (PRAME_HUMAN)
LLSHIHASSYISPEKE

SEQ ID NO: 345282 - protein, 17 aa, Homo sapiens
  Native (PRAME_HUMAN)
LLSHIHASSYISPEKEE

SEQ ID NO: 345283 - protein, 18 aa, Homo sapiens
  Native (PRAME_HUMAN)
LLSHIHASSYISPEKEEQ

SEQ ID NO: 345284 - protein, 19 aa, Homo sapiens
  Native (PRAME_HUMAN)
LLSHIHASSYISPEKEEQY

SEQ ID NO: 345285 - protein, 20 aa, Homo sapiens
  Native (PRAME_HUMAN)
LLSHIHASSYISPEKEEQYI

SEQ ID NO: 345286 - protein, 21 aa, Homo sapiens
  Native (PRAME_HUMAN)
LLSHIHASSYISPEKEEQYIA

SEQ ID NO: 345287 - protein, 22 aa, Homo sapiens
  Native (PRAME_HUMAN)
LLSHIHASSYISPEKEEQYIAQ

SEQ ID NO: 345288 - protein, 23 aa, Homo sapiens
  Native (PRAME_HUMAN)
LLSHIHASSYISPEKEEQYIAQF

SEQ ID NO: 345289 - protein, 24 aa, Homo sapiens
  Native (PRAME_HUMAN)
LLSHIHASSYISPEKEEQYIAQFT

SEQ ID NO: 345290 - protein, 25 aa, Homo sapiens
  Native (PRAME_HUMAN)
LLSHIHASSYISPEKEEQYIAQFTS

SEQ ID NO: 345291 - protein, 14 aa, Homo sapiens
  Native (PRAME_HUMAN)
LMKGQHLHLETFKA

SEQ ID NO: 345292 - protein, 15 aa, Homo sapiens
  Native (PRAME_HUMAN)
LMKGQHLHLETFKAV

SEQ ID NO: 345293 - protein, 16 aa, Homo sapiens
  Native (PRAME_HUMAN)
LMKGQHLHLETFKAVL

SEQ ID NO: 345294 - protein, 17 aa, Homo sapiens
  Native (PRAME_HUMAN)
LMKGQHLHLETFKAVLD

SEQ ID NO: 345295 - protein, 18 aa, Homo sapiens
  Native (PRAME_HUMAN)
LMKGQHLHLETFKAVLDG

SEQ ID NO: 345296 - protein, 19 aa, Homo sapiens
  Native (PRAME_HUMAN)
LMKGQHLHLETFKAVLDGL

SEQ ID NO: 345297 - protein, 20 aa, Homo sapiens
  Native (PRAME_HUMAN)
LMKGQHLHLETFKAVLDGLD

SEQ ID NO: 345298 - protein, 21 aa, Homo sapiens
  Native (PRAME_HUMAN)
LMKGQHLHLETFKAVLDGLDV

SEQ ID NO: 345299 - protein, 22 aa, Homo sapiens
  Native (PRAME_HUMAN)
LMKGQHLHLETFKAVLDGLDVL

SEQ ID NO: 345300 - protein, 23 aa, Homo sapiens
  Native (PRAME_HUMAN)
LMKGQHLHLETFKAVLDGLDVLL

SEQ ID NO: 345301 - protein, 24 aa, Homo sapiens
  Native (PRAME_HUMAN)
LMKGQHLHLETFKAVLDGLDVLLA

SEQ ID NO: 345302 - protein, 25 aa, Homo sapiens
  Native (PRAME_HUMAN)
LMKGQHLHLETFKAVLDGLDVLLAQ

SEQ ID NO: 345303 - protein, 13 aa, Homo sapiens
  Native (PRAME_HUMAN)
LPLGVLMKGQHLH

SEQ ID NO: 345304 - protein, 14 aa, Homo sapiens
  Native (PRAME_HUMAN)
LPLGVLMKGQHLHL

SEQ ID NO: 345305 - protein, 15 aa, Homo sapiens
  Native (PRAME_HUMAN)
LPLGVLMKGQHLHLE

SEQ ID NO: 345306 - protein, 16 aa, Homo sapiens
  Native (PRAME_HUMAN)
LPLGVLMKGQHLHLET

SEQ ID NO: 345307 - protein, 17 aa, Homo sapiens
  Native (PRAME_HUMAN)
LPLGVLMKGQHLHLETF

SEQ ID NO: 345308 - protein, 18 aa, Homo sapiens
  Native (PRAME_HUMAN)
LPLGVLMKGQHLHLETFK

SEQ ID NO: 345309 - protein, 19 aa, Homo sapiens
  Native (PRAME_HUMAN)
LPLGVLMKGQHLHLETFKA

SEQ ID NO: 345310 - protein, 20 aa, Homo sapiens
  Native (PRAME_HUMAN)
LPLGVLMKGQHLHLETFKAV

SEQ ID NO: 345311 - protein, 21 aa, Homo sapiens
  Native (PRAME_HUMAN)
LPLGVLMKGQHLHLETFKAVL

SEQ ID NO: 345312 - protein, 22 aa, Homo sapiens
  Native (PRAME_HUMAN)
LPLGVLMKGQHLHLETFKAVLD

SEQ ID NO: 345313 - protein, 23 aa, Homo sapiens
  Native (PRAME_HUMAN)
LPLGVLMKGQHLHLETFKAVLDG

SEQ ID NO: 345314 - protein, 24 aa, Homo sapiens
  Native (PRAME_HUMAN)
LPLGVLMKGQHLHLETFKAVLDGL

SEQ ID NO: 345315 - protein, 25 aa, Homo sapiens
  Native (PRAME_HUMAN)
LPLGVLMKGQHLHLETFKAVLDGLD

SEQ ID NO: 345316 - protein, 13 aa, Homo sapiens
  Native (PRAME_HUMAN)
LPRELFPPLFMAA

SEQ ID NO: 345317 - protein, 14 aa, Homo sapiens
  Native (PRAME_HUMAN)
LPRELFPPLFMAAF

SEQ ID NO: 345318 - protein, 15 aa, Homo sapiens
  Native (PRAME_HUMAN)
LPRELFPPLFMAAFD

SEQ ID NO: 345319 - protein, 16 aa, Homo sapiens
  Native (PRAME_HUMAN)
LPRELFPPLFMAAFDG

SEQ ID NO: 345320 - protein, 17 aa, Homo sapiens
  Native (PRAME_HUMAN)
LPRELFPPLFMAAFDGR

SEQ ID NO: 345321 - protein, 18 aa, Homo sapiens
  Native (PRAME_HUMAN)
LPRELFPPLFMAAFDGRH

SEQ ID NO: 345322 - protein, 19 aa, Homo sapiens
  Native (PRAME_HUMAN)
LPRELFPPLFMAAFDGRHS

SEQ ID NO: 345323 - protein, 20 aa, Homo sapiens
  Native (PRAME_HUMAN)
LPRELFPPLFMAAFDGRHSQ

SEQ ID NO: 345324 - protein, 21 aa, Homo sapiens
  Native (PRAME_HUMAN)
LPRELFPPLFMAAFDGRHSQT

SEQ ID NO: 345325 - protein, 22 aa, Homo sapiens
  Native (PRAME_HUMAN)
LPRELFPPLFMAAFDGRHSQTL

SEQ ID NO: 345326 - protein, 23 aa, Homo sapiens
  Native (PRAME_HUMAN)
LPRELFPPLFMAAFDGRHSQTLK

SEQ ID NO: 345327 - protein, 24 aa, Homo sapiens
  Native (PRAME_HUMAN)
LPRELFPPLFMAAFDGRHSQTLKA

SEQ ID NO: 345328 - protein, 25 aa, Homo sapiens
  Native (PRAME_HUMAN)
LPRELFPPLFMAAFDGRHSQTLKAM

SEQ ID NO: 345329 - protein, 15 aa, Homo sapiens
  Native (PRAME_HUMAN)
LPSLSHCSQLTTLSF

SEQ ID NO: 345330 - protein, 16 aa, Homo sapiens
  Native (PRAME_HUMAN)
LPSLSHCSQLTTLSFY

SEQ ID NO: 345331 - protein, 17 aa, Homo sapiens
  Native (PRAME_HUMAN)
LPSLSHCSQLTTLSFYG

SEQ ID NO: 345332 - protein, 19 aa, Homo sapiens
  Native (PRAME_HUMAN)
LPSLSHCSQLTTLSFYGNS

SEQ ID NO: 345333 - protein, 20 aa, Homo sapiens
  Native (PRAME_HUMAN)
LPSLSHCSQLTTLSFYGNSI

SEQ ID NO: 345334 - protein, 21 aa, Homo sapiens
  Native (PRAME_HUMAN)
LPSLSHCSQLTTLSFYGNSIS

SEQ ID NO: 345335 - protein, 22 aa, Homo sapiens
  Native (PRAME_HUMAN)
LPSLSHCSQLTTLSFYGNSISI

SEQ ID NO: 345336 - protein, 23 aa, Homo sapiens
  Native (PRAME_HUMAN)
LPSLSHCSQLTTLSFYGNSISIS

SEQ ID NO: 345337 - protein, 24 aa, Homo sapiens
  Native (PRAME_HUMAN)
LPSLSHCSQLTTLSFYGNSISISA

SEQ ID NO: 345338 - protein, 25 aa, Homo sapiens
  Native (PRAME_HUMAN)
LPSLSHCSQLTTLSFYGNSISISAL

SEQ ID NO: 345339 - protein, 14 aa, Homo sapiens
  Native (PRAME_HUMAN)
LPTLAKFSPYLGQM

SEQ ID NO: 345340 - protein, 15 aa, Homo sapiens
  Native (PRAME_HUMAN)
LPTLAKFSPYLGQMI

SEQ ID NO: 345341 - protein, 16 aa, Homo sapiens
  Native (PRAME_HUMAN)
LPTLAKFSPYLGQMIN

SEQ ID NO: 345342 - protein, 17 aa, Homo sapiens
  Native (PRAME_HUMAN)
LPTLAKFSPYLGQMINL

SEQ ID NO: 345343 - protein, 18 aa, Homo sapiens
  Native (PRAME_HUMAN)
LPTLAKFSPYLGQMINLR

SEQ ID NO: 345344 - protein, 19 aa, Homo sapiens
  Native (PRAME_HUMAN)
LPTLAKFSPYLGQMINLRR

SEQ ID NO: 345345 - protein, 20 aa, Homo sapiens
  Native (PRAME_HUMAN)
LPTLAKFSPYLGQMINLRRL

SEQ ID NO: 345346 - protein, 21 aa, Homo sapiens
  Native (PRAME_HUMAN)
LPTLAKFSPYLGQMINLRRLL

SEQ ID NO: 345347 - protein, 22 aa, Homo sapiens
  Native (PRAME_HUMAN)
LPTLAKFSPYLGQMINLRRLLL

SEQ ID NO: 345348 - protein, 23 aa, Homo sapiens
  Native (PRAME_HUMAN)
LPTLAKFSPYLGQMINLRRLLLS

SEQ ID NO: 345349 - protein, 24 aa, Homo sapiens
  Native (PRAME_HUMAN)
LPTLAKFSPYLGQMINLRRLLLSH

SEQ ID NO: 345350 - protein, 25 aa, Homo sapiens
  Native (PRAME_HUMAN)
LPTLAKFSPYLGQMINLRRLLLSHI

SEQ ID NO: 345351 - protein, 14 aa, Homo sapiens
  Native (PRAME_HUMAN)
LQALLERASATLQD

SEQ ID NO: 345352 - protein, 15 aa, Homo sapiens
  Native (PRAME_HUMAN)
LQALLERASATLQDL

SEQ ID NO: 345353 - protein, 16 aa, Homo sapiens
  Native (PRAME_HUMAN)
LQALLERASATLQDLV

SEQ ID NO: 345354 - protein, 17 aa, Homo sapiens
  Native (PRAME_HUMAN)
LQALLERASATLQDLVF

SEQ ID NO: 345355 - protein, 18 aa, Homo sapiens
  Native (PRAME_HUMAN)
LQALLERASATLQDLVFD

SEQ ID NO: 345356 - protein, 19 aa, Homo sapiens
  Native (PRAME_HUMAN)
LQALLERASATLQDLVFDE

SEQ ID NO: 345357 - protein, 20 aa, Homo sapiens
  Native (PRAME_HUMAN)
LQALLERASATLQDLVFDEC

SEQ ID NO: 345358 - protein, 21 aa, Homo sapiens
  Native (PRAME_HUMAN)
LQALLERASATLQDLVFDECG

SEQ ID NO: 345359 - protein, 22 aa, Homo sapiens
  Native (PRAME_HUMAN)
LQALLERASATLQDLVFDECGI

SEQ ID NO: 345360 - protein, 23 aa, Homo sapiens
  Native (PRAME_HUMAN)
LQALLERASATLQDLVFDECGIT

SEQ ID NO: 345361 - protein, 24 aa, Homo sapiens
  Native (PRAME_HUMAN)
LQALLERASATLQDLVFDECGITD

SEQ ID NO: 345362 - protein, 25 aa, Homo sapiens
  Native (PRAME_HUMAN)
LQALLERASATLQDLVFDECGITDD

SEQ ID NO: 345363 - protein, 13 aa, Homo sapiens
  Native (PRAME_HUMAN)
LQALYVDSLFFLR

SEQ ID NO: 345364 - protein, 14 aa, Homo sapiens
  Native (PRAME_HUMAN)
LQALYVDSLFFLRG

SEQ ID NO: 345365 - protein, 15 aa, Homo sapiens
  Native (PRAME_HUMAN)
LQALYVDSLFFLRGR

SEQ ID NO: 345366 - protein, 16 aa, Homo sapiens
  Native (PRAME_HUMAN)
LQALYVDSLFFLRGRL

SEQ ID NO: 345367 - protein, 17 aa, Homo sapiens
  Native (PRAME_HUMAN)
LQALYVDSLFFLRGRLD

SEQ ID NO: 345368 - protein, 18 aa, Homo sapiens
  Native (PRAME_HUMAN)
LQALYVDSLFFLRGRLDQ

SEQ ID NO: 345369 - protein, 19 aa, Homo sapiens
  Native (PRAME_HUMAN)
LQALYVDSLFFLRGRLDQL

SEQ ID NO: 345370 - protein, 20 aa, Homo sapiens
  Native (PRAME_HUMAN)
LQALYVDSLFFLRGRLDQLL

SEQ ID NO: 345371 - protein, 21 aa, Homo sapiens
  Native (PRAME_HUMAN)
LQALYVDSLFFLRGRLDQLLR

SEQ ID NO: 345372 - protein, 22 aa, Homo sapiens
  Native (PRAME_HUMAN)
LQALYVDSLFFLRGRLDQLLRH

SEQ ID NO: 345373 - protein, 23 aa, Homo sapiens
  Native (PRAME_HUMAN)
LQALYVDSLFFLRGRLDQLLRHV

SEQ ID NO: 345374 - protein, 24 aa, Homo sapiens
  Native (PRAME_HUMAN)
LQALYVDSLFFLRGRLDQLLRHVM

SEQ ID NO: 345375 - protein, 25 aa, Homo sapiens
  Native (PRAME_HUMAN)
LQALYVDSLFFLRGRLDQLLRHVMN

SEQ ID NO: 345376 - protein, 13 aa, Homo sapiens
  Native (PRAME_HUMAN)
LQCLQALYVDSLF

SEQ ID NO: 345377 - protein, 14 aa, Homo sapiens
  Native (PRAME_HUMAN)
LQCLQALYVDSLFF

SEQ ID NO: 345378 - protein, 15 aa, Homo sapiens
  Native (PRAME_HUMAN)
LQCLQALYVDSLFFL

SEQ ID NO: 345379 - protein, 16 aa, Homo sapiens
  Native (PRAME_HUMAN)
LQCLQALYVDSLFFLR

SEQ ID NO: 345380 - protein, 17 aa, Homo sapiens
  Native (PRAME_HUMAN)
LQCLQALYVDSLFFLRG

SEQ ID NO: 345381 - protein, 18 aa, Homo sapiens
  Native (PRAME_HUMAN)
LQCLQALYVDSLFFLRGR

SEQ ID NO: 345382 - protein, 19 aa, Homo sapiens
  Native (PRAME_HUMAN)
LQCLQALYVDSLFFLRGRL

SEQ ID NO: 345383 - protein, 20 aa, Homo sapiens
  Native (PRAME_HUMAN)
LQCLQALYVDSLFFLRGRLD

SEQ ID NO: 345384 - protein, 21 aa, Homo sapiens
  Native (PRAME_HUMAN)
LQCLQALYVDSLFFLRGRLDQ

SEQ ID NO: 345385 - protein, 22 aa, Homo sapiens
  Native (PRAME_HUMAN)
LQCLQALYVDSLFFLRGRLDQL

SEQ ID NO: 345386 - protein, 23 aa, Homo sapiens
  Native (PRAME_HUMAN)
LQCLQALYVDSLFFLRGRLDQLL

SEQ ID NO: 345387 - protein, 24 aa, Homo sapiens
  Native (PRAME_HUMAN)
LQCLQALYVDSLFFLRGRLDQLLR

SEQ ID NO: 345388 - protein, 25 aa, Homo sapiens
  Native (PRAME_HUMAN)
LQCLQALYVDSLFFLRGRLDQLLRH

SEQ ID NO: 345389 - protein, 19 aa, Homo sapiens
  Native (PRAME_HUMAN)
LQDLVFDECGITDDQLLAL

SEQ ID NO: 345390 - protein, 20 aa, Homo sapiens
  Native (PRAME_HUMAN)
LQDLVFDECGITDDQLLALL

SEQ ID NO: 345391 - protein, 21 aa, Homo sapiens
  Native (PRAME_HUMAN)
LQDLVFDECGITDDQLLALLP

SEQ ID NO: 345392 - protein, 22 aa, Homo sapiens
  Native (PRAME_HUMAN)
LQDLVFDECGITDDQLLALLPS

SEQ ID NO: 345393 - protein, 23 aa, Homo sapiens
  Native (PRAME_HUMAN)
LQDLVFDECGITDDQLLALLPSL

SEQ ID NO: 345394 - protein, 24 aa, Homo sapiens
  Native (PRAME_HUMAN)
LQDLVFDECGITDDQLLALLPSLS

SEQ ID NO: 345395 - protein, 13 aa, Homo sapiens
  Native (PRAME_HUMAN)
LQHLIGLSNLTHV

SEQ ID NO: 345396 - protein, 14 aa, Homo sapiens
  Native (PRAME_HUMAN)
LQHLIGLSNLTHVL

SEQ ID NO: 345397 - protein, 15 aa, Homo sapiens
  Native (PRAME_HUMAN)
LQHLIGLSNLTHVLY

SEQ ID NO: 345398 - protein, 16 aa, Homo sapiens
  Native (PRAME_HUMAN)
LQHLIGLSNLTHVLYP

SEQ ID NO: 345399 - protein, 17 aa, Homo sapiens
  Native (PRAME_HUMAN)
LQHLIGLSNLTHVLYPV

SEQ ID NO: 345400 - protein, 18 aa, Homo sapiens
  Native (PRAME_HUMAN)
LQHLIGLSNLTHVLYPVP

SEQ ID NO: 345401 - protein, 19 aa, Homo sapiens
  Native (PRAME_HUMAN)
LQHLIGLSNLTHVLYPVPL

SEQ ID NO: 345402 - protein, 20 aa, Homo sapiens
  Native (PRAME_HUMAN)
LQHLIGLSNLTHVLYPVPLE

SEQ ID NO: 345403 - protein, 21 aa, Homo sapiens
  Native (PRAME_HUMAN)
LQHLIGLSNLTHVLYPVPLES

SEQ ID NO: 345404 - protein, 22 aa, Homo sapiens
  Native (PRAME_HUMAN)
LQHLIGLSNLTHVLYPVPLESY

SEQ ID NO: 345405 - protein, 23 aa, Homo sapiens
  Native (PRAME_HUMAN)
LQHLIGLSNLTHVLYPVPLESYE

SEQ ID NO: 345406 - protein, 24 aa, Homo sapiens
  Native (PRAME_HUMAN)
LQHLIGLSNLTHVLYPVPLESYED

SEQ ID NO: 345407 - protein, 25 aa, Homo sapiens
  Native (PRAME_HUMAN)
LQHLIGLSNLTHVLYPVPLESYEDI

SEQ ID NO: 345408 - protein, 13 aa, Homo sapiens
  Native (PRAME_HUMAN)
LQSLLQHLIGLSN

SEQ ID NO: 345409 - protein, 14 aa, Homo sapiens
  Native (PRAME_HUMAN)
LQSLLQHLIGLSNL

SEQ ID NO: 345410 - protein, 15 aa, Homo sapiens
  Native (PRAME_HUMAN)
LQSLLQHLIGLSNLT

SEQ ID NO: 345411 - protein, 16 aa, Homo sapiens
  Native (PRAME_HUMAN)
LQSLLQHLIGLSNLTH

SEQ ID NO: 345412 - protein, 17 aa, Homo sapiens
  Native (PRAME_HUMAN)
LQSLLQHLIGLSNLTHV

SEQ ID NO: 345413 - protein, 18 aa, Homo sapiens
  Native (PRAME_HUMAN)
LQSLLQHLIGLSNLTHVL

SEQ ID NO: 345414 - protein, 19 aa, Homo sapiens
  Native (PRAME_HUMAN)
LQSLLQHLIGLSNLTHVLY

SEQ ID NO: 345415 - protein, 20 aa, Homo sapiens
  Native (PRAME_HUMAN)
LQSLLQHLIGLSNLTHVLYP

SEQ ID NO: 345416 - protein, 21 aa, Homo sapiens
  Native (PRAME_HUMAN)
LQSLLQHLIGLSNLTHVLYPV

SEQ ID NO: 345417 - protein, 22 aa, Homo sapiens
  Native (PRAME_HUMAN)
LQSLLQHLIGLSNLTHVLYPVP

SEQ ID NO: 345418 - protein, 23 aa, Homo sapiens
  Native (PRAME_HUMAN)
LQSLLQHLIGLSNLTHVLYPVPL

SEQ ID NO: 345419 - protein, 24 aa, Homo sapiens
  Native (PRAME_HUMAN)
LQSLLQHLIGLSNLTHVLYPVPLE

SEQ ID NO: 345420 - protein, 25 aa, Homo sapiens
  Native (PRAME_HUMAN)
LQSLLQHLIGLSNLTHVLYPVPLES

SEQ ID NO: 345421 - protein, 14 aa, Homo sapiens
  Native (PRAME_HUMAN)
LQVLDLRKNSHQDF

SEQ ID NO: 345422 - protein, 15 aa, Homo sapiens
  Native (PRAME_HUMAN)
LQVLDLRKNSHQDFW

SEQ ID NO: 345423 - protein, 16 aa, Homo sapiens
  Native (PRAME_HUMAN)
LQVLDLRKNSHQDFWT

SEQ ID NO: 345424 - protein, 17 aa, Homo sapiens
  Native (PRAME_HUMAN)
LQVLDLRKNSHQDFWTV

SEQ ID NO: 345425 - protein, 18 aa, Homo sapiens
  Native (PRAME_HUMAN)
LQVLDLRKNSHQDFWTVW

SEQ ID NO: 345426 - protein, 19 aa, Homo sapiens
  Native (PRAME_HUMAN)
LQVLDLRKNSHQDFWTVWS

SEQ ID NO: 345427 - protein, 20 aa, Homo sapiens
  Native (PRAME_HUMAN)
LQVLDLRKNSHQDFWTVWSG

SEQ ID NO: 345428 - protein, 21 aa, Homo sapiens
  Native (PRAME_HUMAN)
LQVLDLRKNSHQDFWTVWSGN

SEQ ID NO: 345429 - protein, 22 aa, Homo sapiens
  Native (PRAME_HUMAN)
LQVLDLRKNSHQDFWTVWSGNR

SEQ ID NO: 345430 - protein, 23 aa, Homo sapiens
  Native (PRAME_HUMAN)
LQVLDLRKNSHQDFWTVWSGNRA

SEQ ID NO: 345431 - protein, 24 aa, Homo sapiens
  Native (PRAME_HUMAN)
LQVLDLRKNSHQDFWTVWSGNRAS

SEQ ID NO: 345432 - protein, 25 aa, Homo sapiens
  Native (PRAME_HUMAN)
LQVLDLRKNSHQDFWTVWSGNRASL

SEQ ID NO: 345433 - protein, 14 aa, Homo sapiens
  Native (PRAME_HUMAN)
LRELLCELGRPSMV

SEQ ID NO: 345434 - protein, 15 aa, Homo sapiens
  Native (PRAME_HUMAN)
LRELLCELGRPSMVW

SEQ ID NO: 345435 - protein, 16 aa, Homo sapiens
  Native (PRAME_HUMAN)
LRELLCELGRPSMVWL

SEQ ID NO: 345436 - protein, 17 aa, Homo sapiens
  Native (PRAME_HUMAN)
LRELLCELGRPSMVWLS

SEQ ID NO: 345437 - protein, 18 aa, Homo sapiens
  Native (PRAME_HUMAN)
LRELLCELGRPSMVWLSA

SEQ ID NO: 345438 - protein, 19 aa, Homo sapiens
  Native (PRAME_HUMAN)
LRELLCELGRPSMVWLSAN

SEQ ID NO: 345439 - protein, 20 aa, Homo sapiens
  Native (PRAME_HUMAN)
LRELLCELGRPSMVWLSANP

SEQ ID NO: 345440 - protein, 21 aa, Homo sapiens
  Native (PRAME_HUMAN)
LRELLCELGRPSMVWLSANPC

SEQ ID NO: 345441 - protein, 22 aa, Homo sapiens
  Native (PRAME_HUMAN)
LRELLCELGRPSMVWLSANPCP

SEQ ID NO: 345442 - protein, 23 aa, Homo sapiens
  Native (PRAME_HUMAN)
LRELLCELGRPSMVWLSANPCPH

SEQ ID NO: 345443 - protein, 24 aa, Homo sapiens
  Native (PRAME_HUMAN)
LRELLCELGRPSMVWLSANPCPHC

SEQ ID NO: 345444 - protein, 25 aa, Homo sapiens
  Native (PRAME_HUMAN)
LRELLCELGRPSMVWLSANPCPHCG

SEQ ID NO: 345445 - protein, 14 aa, Homo sapiens
  Native (PRAME_HUMAN)
LRGRLDQLLRHVMN

SEQ ID NO: 345446 - protein, 15 aa, Homo sapiens
  Native (PRAME_HUMAN)
LRGRLDQLLRHVMNP

SEQ ID NO: 345447 - protein, 16 aa, Homo sapiens
  Native (PRAME_HUMAN)
LRGRLDQLLRHVMNPL

SEQ ID NO: 345448 - protein, 17 aa, Homo sapiens
  Native (PRAME_HUMAN)
LRGRLDQLLRHVMNPLE

SEQ ID NO: 345449 - protein, 18 aa, Homo sapiens
  Native (PRAME_HUMAN)
LRGRLDQLLRHVMNPLET

SEQ ID NO: 345450 - protein, 19 aa, Homo sapiens
  Native (PRAME_HUMAN)
LRGRLDQLLRHVMNPLETL

SEQ ID NO: 345451 - protein, 20 aa, Homo sapiens
  Native (PRAME_HUMAN)
LRGRLDQLLRHVMNPLETLS

SEQ ID NO: 345452 - protein, 21 aa, Homo sapiens
  Native (PRAME_HUMAN)
LRGRLDQLLRHVMNPLETLSI

SEQ ID NO: 345453 - protein, 22 aa, Homo sapiens
  Native (PRAME_HUMAN)
LRGRLDQLLRHVMNPLETLSIT

SEQ ID NO: 345454 - protein, 23 aa, Homo sapiens
  Native (PRAME_HUMAN)
LRGRLDQLLRHVMNPLETLSITN

SEQ ID NO: 345455 - protein, 24 aa, Homo sapiens
  Native (PRAME_HUMAN)
LRGRLDQLLRHVMNPLETLSITNC

SEQ ID NO: 345456 - protein, 25 aa, Homo sapiens
  Native (PRAME_HUMAN)
LRGRLDQLLRHVMNPLETLSITNCR

SEQ ID NO: 345457 - protein, 13 aa, Homo sapiens
  Native (PRAME_HUMAN)
LRHVMNPLETLSI

SEQ ID NO: 345458 - protein, 14 aa, Homo sapiens
  Native (PRAME_HUMAN)
LRHVMNPLETLSIT

SEQ ID NO: 345459 - protein, 15 aa, Homo sapiens
  Native (PRAME_HUMAN)
LRHVMNPLETLSITN

SEQ ID NO: 345460 - protein, 16 aa, Homo sapiens
  Native (PRAME_HUMAN)
LRHVMNPLETLSITNC

SEQ ID NO: 345461 - protein, 17 aa, Homo sapiens
  Native (PRAME_HUMAN)
LRHVMNPLETLSITNCR

SEQ ID NO: 345462 - protein, 18 aa, Homo sapiens
  Native (PRAME_HUMAN)
LRHVMNPLETLSITNCRL

SEQ ID NO: 345463 - protein, 19 aa, Homo sapiens
  Native (PRAME_HUMAN)
LRHVMNPLETLSITNCRLS

SEQ ID NO: 345464 - protein, 20 aa, Homo sapiens
  Native (PRAME_HUMAN)
LRHVMNPLETLSITNCRLSE

SEQ ID NO: 345465 - protein, 21 aa, Homo sapiens
  Native (PRAME_HUMAN)
LRHVMNPLETLSITNCRLSEG

SEQ ID NO: 345466 - protein, 22 aa, Homo sapiens
  Native (PRAME_HUMAN)
LRHVMNPLETLSITNCRLSEGD

SEQ ID NO: 345467 - protein, 23 aa, Homo sapiens
  Native (PRAME_HUMAN)
LRHVMNPLETLSITNCRLSEGDV

SEQ ID NO: 345468 - protein, 24 aa, Homo sapiens
  Native (PRAME_HUMAN)
LRHVMNPLETLSITNCRLSEGDVM

SEQ ID NO: 345469 - protein, 25 aa, Homo sapiens
  Native (PRAME_HUMAN)
LRHVMNPLETLSITNCRLSEGDVMH

SEQ ID NO: 345470 - protein, 16 aa, Homo sapiens
  Native (PRAME_HUMAN)
LRKNSHQDFWTVWSGN

SEQ ID NO: 345471 - protein, 17 aa, Homo sapiens
  Native (PRAME_HUMAN)
LRKNSHQDFWTVWSGNR

SEQ ID NO: 345472 - protein, 18 aa, Homo sapiens
  Native (PRAME_HUMAN)
LRKNSHQDFWTVWSGNRA

SEQ ID NO: 345473 - protein, 19 aa, Homo sapiens
  Native (PRAME_HUMAN)
LRKNSHQDFWTVWSGNRAS

SEQ ID NO: 345474 - protein, 20 aa, Homo sapiens
  Native (PRAME_HUMAN)
LRKNSHQDFWTVWSGNRASL

SEQ ID NO: 345475 - protein, 21 aa, Homo sapiens
  Native (PRAME_HUMAN)
LRKNSHQDFWTVWSGNRASLY

SEQ ID NO: 345476 - protein, 22 aa, Homo sapiens
  Native (PRAME_HUMAN)
LRKNSHQDFWTVWSGNRASLYS

SEQ ID NO: 345477 - protein, 23 aa, Homo sapiens
  Native (PRAME_HUMAN)
LRKNSHQDFWTVWSGNRASLYSF

SEQ ID NO: 345478 - protein, 24 aa, Homo sapiens
  Native (PRAME_HUMAN)
LRKNSHQDFWTVWSGNRASLYSFP

SEQ ID NO: 345479 - protein, 25 aa, Homo sapiens
  Native (PRAME_HUMAN)
LRKNSHQDFWTVWSGNRASLYSFPE

SEQ ID NO: 345480 - protein, 13 aa, Homo sapiens
  Native (PRAME_HUMAN)
LRLCCKKLKIFAM

SEQ ID NO: 345481 - protein, 14 aa, Homo sapiens
  Native (PRAME_HUMAN)
LRLCCKKLKIFAMP

SEQ ID NO: 345482 - protein, 15 aa, Homo sapiens
  Native (PRAME_HUMAN)
LRLCCKKLKIFAMPM

SEQ ID NO: 345483 - protein, 16 aa, Homo sapiens
  Native (PRAME_HUMAN)
LRLCCKKLKIFAMPMQ

SEQ ID NO: 345484 - protein, 17 aa, Homo sapiens
  Native (PRAME_HUMAN)
LRLCCKKLKIFAMPMQD

SEQ ID NO: 345485 - protein, 18 aa, Homo sapiens
  Native (PRAME_HUMAN)
LRLCCKKLKIFAMPMQDI

SEQ ID NO: 345486 - protein, 19 aa, Homo sapiens
  Native (PRAME_HUMAN)
LRLCCKKLKIFAMPMQDIK

SEQ ID NO: 345487 - protein, 20 aa, Homo sapiens
  Native (PRAME_HUMAN)
LRLCCKKLKIFAMPMQDIKM

SEQ ID NO: 345488 - protein, 21 aa, Homo sapiens
  Native (PRAME_HUMAN)
LRLCCKKLKIFAMPMQDIKMI

SEQ ID NO: 345489 - protein, 22 aa, Homo sapiens
  Native (PRAME_HUMAN)
LRLCCKKLKIFAMPMQDIKMIL

SEQ ID NO: 345490 - protein, 23 aa, Homo sapiens
  Native (PRAME_HUMAN)
LRLCCKKLKIFAMPMQDIKMILK

SEQ ID NO: 345491 - protein, 24 aa, Homo sapiens
  Native (PRAME_HUMAN)
LRLCCKKLKIFAMPMQDIKMILKM

SEQ ID NO: 345492 - protein, 25 aa, Homo sapiens
  Native (PRAME_HUMAN)
LRLCCKKLKIFAMPMQDIKMILKMV

SEQ ID NO: 345493 - protein, 13 aa, Homo sapiens
  Native (PRAME_HUMAN)
LRRLLLSHIHASS

SEQ ID NO: 345494 - protein, 14 aa, Homo sapiens
  Native (PRAME_HUMAN)
LRRLLLSHIHASSY

SEQ ID NO: 345495 - protein, 15 aa, Homo sapiens
  Native (PRAME_HUMAN)
LRRLLLSHIHASSYI

SEQ ID NO: 345496 - protein, 16 aa, Homo sapiens
  Native (PRAME_HUMAN)
LRRLLLSHIHASSYIS

SEQ ID NO: 345497 - protein, 17 aa, Homo sapiens
  Native (PRAME_HUMAN)
LRRLLLSHIHASSYISP

SEQ ID NO: 345498 - protein, 18 aa, Homo sapiens
  Native (PRAME_HUMAN)
LRRLLLSHIHASSYISPE

SEQ ID NO: 345499 - protein, 19 aa, Homo sapiens
  Native (PRAME_HUMAN)
LRRLLLSHIHASSYISPEK

SEQ ID NO: 345500 - protein, 20 aa, Homo sapiens
  Native (PRAME_HUMAN)
LRRLLLSHIHASSYISPEKE

SEQ ID NO: 345501 - protein, 21 aa, Homo sapiens
  Native (PRAME_HUMAN)
LRRLLLSHIHASSYISPEKEE

SEQ ID NO: 345502 - protein, 22 aa, Homo sapiens
  Native (PRAME_HUMAN)
LRRLLLSHIHASSYISPEKEEQ

SEQ ID NO: 345503 - protein, 23 aa, Homo sapiens
  Native (PRAME_HUMAN)
LRRLLLSHIHASSYISPEKEEQY

SEQ ID NO: 345504 - protein, 24 aa, Homo sapiens
  Native (PRAME_HUMAN)
LRRLLLSHIHASSYISPEKEEQYI

SEQ ID NO: 345505 - protein, 25 aa, Homo sapiens
  Native (PRAME_HUMAN)
LRRLLLSHIHASSYISPEKEEQYIA

SEQ ID NO: 345506 - protein, 15 aa, Homo sapiens
  Native (PRAME_HUMAN)
LSEGDVMHLSQSPSV

SEQ ID NO: 345507 - protein, 16 aa, Homo sapiens
  Native (PRAME_HUMAN)
LSEGDVMHLSQSPSVS

SEQ ID NO: 345508 - protein, 17 aa, Homo sapiens
  Native (PRAME_HUMAN)
LSEGDVMHLSQSPSVSQ

SEQ ID NO: 345509 - protein, 19 aa, Homo sapiens
  Native (PRAME_HUMAN)
LSEGDVMHLSQSPSVSQLS

SEQ ID NO: 345510 - protein, 20 aa, Homo sapiens
  Native (PRAME_HUMAN)
LSEGDVMHLSQSPSVSQLSV

SEQ ID NO: 345511 - protein, 21 aa, Homo sapiens
  Native (PRAME_HUMAN)
LSEGDVMHLSQSPSVSQLSVL

SEQ ID NO: 345512 - protein, 22 aa, Homo sapiens
  Native (PRAME_HUMAN)
LSEGDVMHLSQSPSVSQLSVLS

SEQ ID NO: 345513 - protein, 23 aa, Homo sapiens
  Native (PRAME_HUMAN)
LSEGDVMHLSQSPSVSQLSVLSL

SEQ ID NO: 345514 - protein, 24 aa, Homo sapiens
  Native (PRAME_HUMAN)
LSEGDVMHLSQSPSVSQLSVLSLS

SEQ ID NO: 345515 - protein, 25 aa, Homo sapiens
  Native (PRAME_HUMAN)
LSEGDVMHLSQSPSVSQLSVLSLSG

SEQ ID NO: 345516 - protein, 13 aa, Homo sapiens
  Native (PRAME_HUMAN)
LSFYGNSISISAL

SEQ ID NO: 345517 - protein, 14 aa, Homo sapiens
  Native (PRAME_HUMAN)
LSFYGNSISISALQ

SEQ ID NO: 345518 - protein, 15 aa, Homo sapiens
  Native (PRAME_HUMAN)
LSFYGNSISISALQS

SEQ ID NO: 345519 - protein, 16 aa, Homo sapiens
  Native (PRAME_HUMAN)
LSFYGNSISISALQSL

SEQ ID NO: 345520 - protein, 17 aa, Homo sapiens
  Native (PRAME_HUMAN)
LSFYGNSISISALQSLL

SEQ ID NO: 345521 - protein, 18 aa, Homo sapiens
  Native (PRAME_HUMAN)
LSFYGNSISISALQSLLQ

SEQ ID NO: 345522 - protein, 19 aa, Homo sapiens
  Native (PRAME_HUMAN)
LSFYGNSISISALQSLLQH

SEQ ID NO: 345523 - protein, 20 aa, Homo sapiens
  Native (PRAME_HUMAN)
LSFYGNSISISALQSLLQHL

SEQ ID NO: 345524 - protein, 21 aa, Homo sapiens
  Native (PRAME_HUMAN)
LSFYGNSISISALQSLLQHLI

SEQ ID NO: 345525 - protein, 22 aa, Homo sapiens
  Native (PRAME_HUMAN)
LSFYGNSISISALQSLLQHLIG

SEQ ID NO: 345526 - protein, 23 aa, Homo sapiens
  Native (PRAME_HUMAN)
LSFYGNSISISALQSLLQHLIGL

SEQ ID NO: 345527 - protein, 24 aa, Homo sapiens
  Native (PRAME_HUMAN)
LSFYGNSISISALQSLLQHLIGLS

SEQ ID NO: 345528 - protein, 25 aa, Homo sapiens
  Native (PRAME_HUMAN)
LSFYGNSISISALQSLLQHLIGLSN

SEQ ID NO: 345529 - protein, 14 aa, Homo sapiens
  Native (PRAME_HUMAN)
LSGVMLTDVSPEPL

SEQ ID NO: 345530 - protein, 15 aa, Homo sapiens
  Native (PRAME_HUMAN)
LSGVMLTDVSPEPLQ

SEQ ID NO: 345531 - protein, 16 aa, Homo sapiens
  Native (PRAME_HUMAN)
LSGVMLTDVSPEPLQA

SEQ ID NO: 345532 - protein, 17 aa, Homo sapiens
  Native (PRAME_HUMAN)
LSGVMLTDVSPEPLQAL

SEQ ID NO: 345533 - protein, 18 aa, Homo sapiens
  Native (PRAME_HUMAN)
LSGVMLTDVSPEPLQALL

SEQ ID NO: 345534 - protein, 19 aa, Homo sapiens
  Native (PRAME_HUMAN)
LSGVMLTDVSPEPLQALLE

SEQ ID NO: 345535 - protein, 20 aa, Homo sapiens
  Native (PRAME_HUMAN)
LSGVMLTDVSPEPLQALLER

SEQ ID NO: 345536 - protein, 21 aa, Homo sapiens
  Native (PRAME_HUMAN)
LSGVMLTDVSPEPLQALLERA

SEQ ID NO: 345537 - protein, 22 aa, Homo sapiens
  Native (PRAME_HUMAN)
LSGVMLTDVSPEPLQALLERAS

SEQ ID NO: 345538 - protein, 23 aa, Homo sapiens
  Native (PRAME_HUMAN)
LSGVMLTDVSPEPLQALLERASA

SEQ ID NO: 345539 - protein, 24 aa, Homo sapiens
  Native (PRAME_HUMAN)
LSGVMLTDVSPEPLQALLERASAT

SEQ ID NO: 345540 - protein, 25 aa, Homo sapiens
  Native (PRAME_HUMAN)
LSGVMLTDVSPEPLQALLERASATL

SEQ ID NO: 345541 - protein, 15 aa, Homo sapiens
  Native (PRAME_HUMAN)
LSHCSQLTTLSFYGN

SEQ ID NO: 345542 - protein, 16 aa, Homo sapiens
  Native (PRAME_HUMAN)
LSHCSQLTTLSFYGNS

SEQ ID NO: 345543 - protein, 17 aa, Homo sapiens
  Native (PRAME_HUMAN)
LSHCSQLTTLSFYGNSI

SEQ ID NO: 345544 - protein, 18 aa, Homo sapiens
  Native (PRAME_HUMAN)
LSHCSQLTTLSFYGNSIS

SEQ ID NO: 345545 - protein, 19 aa, Homo sapiens
  Native (PRAME_HUMAN)
LSHCSQLTTLSFYGNSISI

SEQ ID NO: 345546 - protein, 20 aa, Homo sapiens
  Native (PRAME_HUMAN)
LSHCSQLTTLSFYGNSISIS

SEQ ID NO: 345547 - protein, 21 aa, Homo sapiens
  Native (PRAME_HUMAN)
LSHCSQLTTLSFYGNSISISA

SEQ ID NO: 345548 - protein, 22 aa, Homo sapiens
  Native (PRAME_HUMAN)
LSHCSQLTTLSFYGNSISISAL

SEQ ID NO: 345549 - protein, 23 aa, Homo sapiens
  Native (PRAME_HUMAN)
LSHCSQLTTLSFYGNSISISALQ

SEQ ID NO: 345550 - protein, 24 aa, Homo sapiens
  Native (PRAME_HUMAN)
LSHCSQLTTLSFYGNSISISALQS

SEQ ID NO: 345551 - protein, 25 aa, Homo sapiens
  Native (PRAME_HUMAN)
LSHCSQLTTLSFYGNSISISALQSL

SEQ ID NO: 345552 - protein, 14 aa, Homo sapiens
  Native (PRAME_HUMAN)
LSHIHASSYISPEK

SEQ ID NO: 345553 - protein, 15 aa, Homo sapiens
  Native (PRAME_HUMAN)
LSHIHASSYISPEKE

SEQ ID NO: 345554 - protein, 16 aa, Homo sapiens
  Native (PRAME_HUMAN)
LSHIHASSYISPEKEE

SEQ ID NO: 345555 - protein, 17 aa, Homo sapiens
  Native (PRAME_HUMAN)
LSHIHASSYISPEKEEQ

SEQ ID NO: 345556 - protein, 19 aa, Homo sapiens
  Native (PRAME_HUMAN)
LSHIHASSYISPEKEEQYI

SEQ ID NO: 345557 - protein, 20 aa, Homo sapiens
  Native (PRAME_HUMAN)
LSHIHASSYISPEKEEQYIA

SEQ ID NO: 345558 - protein, 22 aa, Homo sapiens
  Native (PRAME_HUMAN)
LSHIHASSYISPEKEEQYIAQF

SEQ ID NO: 345559 - protein, 23 aa, Homo sapiens
  Native (PRAME_HUMAN)
LSHIHASSYISPEKEEQYIAQFT

SEQ ID NO: 345560 - protein, 24 aa, Homo sapiens
  Native (PRAME_HUMAN)
LSHIHASSYISPEKEEQYIAQFTS

SEQ ID NO: 345561 - protein, 25 aa, Homo sapiens
  Native (PRAME_HUMAN)
LSHIHASSYISPEKEEQYIAQFTSQ

SEQ ID NO: 345562 - protein, 16 aa, Homo sapiens
  Native (PRAME_HUMAN)
LSITNCRLSEGDVMHL

SEQ ID NO: 345563 - protein, 20 aa, Homo sapiens
  Native (PRAME_HUMAN)
LSITNCRLSEGDVMHLSQSP

SEQ ID NO: 345564 - protein, 22 aa, Homo sapiens
  Native (PRAME_HUMAN)
LSITNCRLSEGDVMHLSQSPSV

SEQ ID NO: 345565 - protein, 23 aa, Homo sapiens
  Native (PRAME_HUMAN)
LSITNCRLSEGDVMHLSQSPSVS

SEQ ID NO: 345566 - protein, 24 aa, Homo sapiens
  Native (PRAME_HUMAN)
LSITNCRLSEGDVMHLSQSPSVSQ

SEQ ID NO: 345567 - protein, 25 aa, Homo sapiens
  Native (PRAME_HUMAN)
LSITNCRLSEGDVMHLSQSPSVSQL

SEQ ID NO: 345568 - protein, 13 aa, Homo sapiens
  Native (PRAME_HUMAN)
LSLQCLQALYVDS

SEQ ID NO: 345569 - protein, 14 aa, Homo sapiens
  Native (PRAME_HUMAN)
LSLQCLQALYVDSL

SEQ ID NO: 345570 - protein, 15 aa, Homo sapiens
  Native (PRAME_HUMAN)
LSLQCLQALYVDSLF

SEQ ID NO: 345571 - protein, 16 aa, Homo sapiens
  Native (PRAME_HUMAN)
LSLQCLQALYVDSLFF

SEQ ID NO: 345572 - protein, 17 aa, Homo sapiens
  Native (PRAME_HUMAN)
LSLQCLQALYVDSLFFL

SEQ ID NO: 345573 - protein, 18 aa, Homo sapiens
  Native (PRAME_HUMAN)
LSLQCLQALYVDSLFFLR

SEQ ID NO: 345574 - protein, 19 aa, Homo sapiens
  Native (PRAME_HUMAN)
LSLQCLQALYVDSLFFLRG

SEQ ID NO: 345575 - protein, 20 aa, Homo sapiens
  Native (PRAME_HUMAN)
LSLQCLQALYVDSLFFLRGR

SEQ ID NO: 345576 - protein, 21 aa, Homo sapiens
  Native (PRAME_HUMAN)
LSLQCLQALYVDSLFFLRGRL

SEQ ID NO: 345577 - protein, 22 aa, Homo sapiens
  Native (PRAME_HUMAN)
LSLQCLQALYVDSLFFLRGRLD

SEQ ID NO: 345578 - protein, 23 aa, Homo sapiens
  Native (PRAME_HUMAN)
LSLQCLQALYVDSLFFLRGRLDQ

SEQ ID NO: 345579 - protein, 24 aa, Homo sapiens
  Native (PRAME_HUMAN)
LSLQCLQALYVDSLFFLRGRLDQL

SEQ ID NO: 345580 - protein, 25 aa, Homo sapiens
  Native (PRAME_HUMAN)
LSLQCLQALYVDSLFFLRGRLDQLL

SEQ ID NO: 345581 - protein, 13 aa, Homo sapiens
  Native (PRAME_HUMAN)
LSLSGVMLTDVSP

SEQ ID NO: 345582 - protein, 14 aa, Homo sapiens
  Native (PRAME_HUMAN)
LSLSGVMLTDVSPE

SEQ ID NO: 345583 - protein, 15 aa, Homo sapiens
  Native (PRAME_HUMAN)
LSLSGVMLTDVSPEP

SEQ ID NO: 345584 - protein, 16 aa, Homo sapiens
  Native (PRAME_HUMAN)
LSLSGVMLTDVSPEPL

SEQ ID NO: 345585 - protein, 17 aa, Homo sapiens
  Native (PRAME_HUMAN)
LSLSGVMLTDVSPEPLQ

SEQ ID NO: 345586 - protein, 18 aa, Homo sapiens
  Native (PRAME_HUMAN)
LSLSGVMLTDVSPEPLQA

SEQ ID NO: 345587 - protein, 19 aa, Homo sapiens
  Native (PRAME_HUMAN)
LSLSGVMLTDVSPEPLQAL

SEQ ID NO: 345588 - protein, 20 aa, Homo sapiens
  Native (PRAME_HUMAN)
LSLSGVMLTDVSPEPLQALL

SEQ ID NO: 345589 - protein, 21 aa, Homo sapiens
  Native (PRAME_HUMAN)
LSLSGVMLTDVSPEPLQALLE

SEQ ID NO: 345590 - protein, 22 aa, Homo sapiens
  Native (PRAME_HUMAN)
LSLSGVMLTDVSPEPLQALLER

SEQ ID NO: 345591 - protein, 23 aa, Homo sapiens
  Native (PRAME_HUMAN)
LSLSGVMLTDVSPEPLQALLERA

SEQ ID NO: 345592 - protein, 24 aa, Homo sapiens
  Native (PRAME_HUMAN)
LSLSGVMLTDVSPEPLQALLERAS

SEQ ID NO: 345593 - protein, 25 aa, Homo sapiens
  Native (PRAME_HUMAN)
LSLSGVMLTDVSPEPLQALLERASA

SEQ ID NO: 345594 - protein, 13 aa, Homo sapiens
  Native (PRAME_HUMAN)
LSNLTHVLYPVPL

SEQ ID NO: 345595 - protein, 14 aa, Homo sapiens
  Native (PRAME_HUMAN)
LSNLTHVLYPVPLE

SEQ ID NO: 345596 - protein, 15 aa, Homo sapiens
  Native (PRAME_HUMAN)
LSNLTHVLYPVPLES

SEQ ID NO: 345597 - protein, 16 aa, Homo sapiens
  Native (PRAME_HUMAN)
LSNLTHVLYPVPLESY

SEQ ID NO: 345598 - protein, 17 aa, Homo sapiens
  Native (PRAME_HUMAN)
LSNLTHVLYPVPLESYE

SEQ ID NO: 345599 - protein, 18 aa, Homo sapiens
  Native (PRAME_HUMAN)
LSNLTHVLYPVPLESYED

SEQ ID NO: 345600 - protein, 19 aa, Homo sapiens
  Native (PRAME_HUMAN)
LSNLTHVLYPVPLESYEDI

SEQ ID NO: 345601 - protein, 20 aa, Homo sapiens
  Native (PRAME_HUMAN)
LSNLTHVLYPVPLESYEDIH

SEQ ID NO: 345602 - protein, 21 aa, Homo sapiens
  Native (PRAME_HUMAN)
LSNLTHVLYPVPLESYEDIHG

SEQ ID NO: 345603 - protein, 22 aa, Homo sapiens
  Native (PRAME_HUMAN)
LSNLTHVLYPVPLESYEDIHGT

SEQ ID NO: 345604 - protein, 23 aa, Homo sapiens
  Native (PRAME_HUMAN)
LSNLTHVLYPVPLESYEDIHGTL

SEQ ID NO: 345605 - protein, 24 aa, Homo sapiens
  Native (PRAME_HUMAN)
LSNLTHVLYPVPLESYEDIHGTLH

SEQ ID NO: 345606 - protein, 25 aa, Homo sapiens
  Native (PRAME_HUMAN)
LSNLTHVLYPVPLESYEDIHGTLHL

SEQ ID NO: 345607 - protein, 14 aa, Homo sapiens
  Native (PRAME_HUMAN)
LSQSPSVSQLSVLS

SEQ ID NO: 345608 - protein, 15 aa, Homo sapiens
  Native (PRAME_HUMAN)
LSQSPSVSQLSVLSL

SEQ ID NO: 345609 - protein, 16 aa, Homo sapiens
  Native (PRAME_HUMAN)
LSQSPSVSQLSVLSLS

SEQ ID NO: 345610 - protein, 17 aa, Homo sapiens
  Native (PRAME_HUMAN)
LSQSPSVSQLSVLSLSG

SEQ ID NO: 345611 - protein, 18 aa, Homo sapiens
  Native (PRAME_HUMAN)
LSQSPSVSQLSVLSLSGV

SEQ ID NO: 345612 - protein, 19 aa, Homo sapiens
  Native (PRAME_HUMAN)
LSQSPSVSQLSVLSLSGVM

SEQ ID NO: 345613 - protein, 20 aa, Homo sapiens
  Native (PRAME_HUMAN)
LSQSPSVSQLSVLSLSGVML

SEQ ID NO: 345614 - protein, 21 aa, Homo sapiens
  Native (PRAME_HUMAN)
LSQSPSVSQLSVLSLSGVMLT

SEQ ID NO: 345615 - protein, 22 aa, Homo sapiens
  Native (PRAME_HUMAN)
LSQSPSVSQLSVLSLSGVMLTD

SEQ ID NO: 345616 - protein, 23 aa, Homo sapiens
  Native (PRAME_HUMAN)
LSQSPSVSQLSVLSLSGVMLTDV

SEQ ID NO: 345617 - protein, 24 aa, Homo sapiens
  Native (PRAME_HUMAN)
LSQSPSVSQLSVLSLSGVMLTDVS

SEQ ID NO: 345618 - protein, 25 aa, Homo sapiens
  Native (PRAME_HUMAN)
LSQSPSVSQLSVLSLSGVMLTDVSP

SEQ ID NO: 345619 - protein, 15 aa, Homo sapiens
  Native (PRAME_HUMAN)
LSTEAEQPFIPVEVL

SEQ ID NO: 345620 - protein, 16 aa, Homo sapiens
  Native (PRAME_HUMAN)
LSTEAEQPFIPVEVLV

SEQ ID NO: 345621 - protein, 17 aa, Homo sapiens
  Native (PRAME_HUMAN)
LSTEAEQPFIPVEVLVD

SEQ ID NO: 345622 - protein, 18 aa, Homo sapiens
  Native (PRAME_HUMAN)
LSTEAEQPFIPVEVLVDL

SEQ ID NO: 345623 - protein, 19 aa, Homo sapiens
  Native (PRAME_HUMAN)
LSTEAEQPFIPVEVLVDLF

SEQ ID NO: 345624 - protein, 20 aa, Homo sapiens
  Native (PRAME_HUMAN)
LSTEAEQPFIPVEVLVDLFL

SEQ ID NO: 345625 - protein, 21 aa, Homo sapiens
  Native (PRAME_HUMAN)
LSTEAEQPFIPVEVLVDLFLK

SEQ ID NO: 345626 - protein, 22 aa, Homo sapiens
  Native (PRAME_HUMAN)
LSTEAEQPFIPVEVLVDLFLKE

SEQ ID NO: 345627 - protein, 23 aa, Homo sapiens
  Native (PRAME_HUMAN)
LSTEAEQPFIPVEVLVDLFLKEG

SEQ ID NO: 345628 - protein, 24 aa, Homo sapiens
  Native (PRAME_HUMAN)
LSTEAEQPFIPVEVLVDLFLKEGA

SEQ ID NO: 345629 - protein, 25 aa, Homo sapiens
  Native (PRAME_HUMAN)
LSTEAEQPFIPVEVLVDLFLKEGAC

SEQ ID NO: 345630 - protein, 13 aa, Homo sapiens
  Native (PRAME_HUMAN)
LSVLSLSGVMLTD

SEQ ID NO: 345631 - protein, 14 aa, Homo sapiens
  Native (PRAME_HUMAN)
LSVLSLSGVMLTDV

SEQ ID NO: 345632 - protein, 15 aa, Homo sapiens
  Native (PRAME_HUMAN)
LSVLSLSGVMLTDVS

SEQ ID NO: 345633 - protein, 16 aa, Homo sapiens
  Native (PRAME_HUMAN)
LSVLSLSGVMLTDVSP

SEQ ID NO: 345634 - protein, 17 aa, Homo sapiens
  Native (PRAME_HUMAN)
LSVLSLSGVMLTDVSPE

SEQ ID NO: 345635 - protein, 18 aa, Homo sapiens
  Native (PRAME_HUMAN)
LSVLSLSGVMLTDVSPEP

SEQ ID NO: 345636 - protein, 19 aa, Homo sapiens
  Native (PRAME_HUMAN)
LSVLSLSGVMLTDVSPEPL

SEQ ID NO: 345637 - protein, 20 aa, Homo sapiens
  Native (PRAME_HUMAN)
LSVLSLSGVMLTDVSPEPLQ

SEQ ID NO: 345638 - protein, 21 aa, Homo sapiens
  Native (PRAME_HUMAN)
LSVLSLSGVMLTDVSPEPLQA

SEQ ID NO: 345639 - protein, 22 aa, Homo sapiens
  Native (PRAME_HUMAN)
LSVLSLSGVMLTDVSPEPLQAL

SEQ ID NO: 345640 - protein, 23 aa, Homo sapiens
  Native (PRAME_HUMAN)
LSVLSLSGVMLTDVSPEPLQALL

SEQ ID NO: 345641 - protein, 24 aa, Homo sapiens
  Native (PRAME_HUMAN)
LSVLSLSGVMLTDVSPEPLQALLE

SEQ ID NO: 345642 - protein, 25 aa, Homo sapiens
  Native (PRAME_HUMAN)
LSVLSLSGVMLTDVSPEPLQALLER

SEQ ID NO: 345643 - protein, 14 aa, Homo sapiens
  Native (PRAME_HUMAN)
LTDVSPEPLQALLE

SEQ ID NO: 345644 - protein, 15 aa, Homo sapiens
  Native (PRAME_HUMAN)
LTDVSPEPLQALLER

SEQ ID NO: 345645 - protein, 16 aa, Homo sapiens
  Native (PRAME_HUMAN)
LTDVSPEPLQALLERA

SEQ ID NO: 345646 - protein, 17 aa, Homo sapiens
  Native (PRAME_HUMAN)
LTDVSPEPLQALLERAS

SEQ ID NO: 345647 - protein, 19 aa, Homo sapiens
  Native (PRAME_HUMAN)
LTDVSPEPLQALLERASAT

SEQ ID NO: 345648 - protein, 20 aa, Homo sapiens
  Native (PRAME_HUMAN)
LTDVSPEPLQALLERASATL

SEQ ID NO: 345649 - protein, 21 aa, Homo sapiens
  Native (PRAME_HUMAN)
LTDVSPEPLQALLERASATLQ

SEQ ID NO: 345650 - protein, 22 aa, Homo sapiens
  Native (PRAME_HUMAN)
LTDVSPEPLQALLERASATLQD

SEQ ID NO: 345651 - protein, 23 aa, Homo sapiens
  Native (PRAME_HUMAN)
LTDVSPEPLQALLERASATLQDL

SEQ ID NO: 345652 - protein, 24 aa, Homo sapiens
  Native (PRAME_HUMAN)
LTDVSPEPLQALLERASATLQDLV

SEQ ID NO: 345653 - protein, 25 aa, Homo sapiens
  Native (PRAME_HUMAN)
LTDVSPEPLQALLERASATLQDLVF

SEQ ID NO: 345654 - protein, 13 aa, Homo sapiens
  Native (PRAME_HUMAN)
LTHVLYPVPLESY

SEQ ID NO: 345655 - protein, 14 aa, Homo sapiens
  Native (PRAME_HUMAN)
LTHVLYPVPLESYE

SEQ ID NO: 345656 - protein, 15 aa, Homo sapiens
  Native (PRAME_HUMAN)
LTHVLYPVPLESYED

SEQ ID NO: 345657 - protein, 16 aa, Homo sapiens
  Native (PRAME_HUMAN)
LTHVLYPVPLESYEDI

SEQ ID NO: 345658 - protein, 17 aa, Homo sapiens
  Native (PRAME_HUMAN)
LTHVLYPVPLESYEDIH

SEQ ID NO: 345659 - protein, 18 aa, Homo sapiens
  Native (PRAME_HUMAN)
LTHVLYPVPLESYEDIHG

SEQ ID NO: 345660 - protein, 19 aa, Homo sapiens
  Native (PRAME_HUMAN)
LTHVLYPVPLESYEDIHGT

SEQ ID NO: 345661 - protein, 20 aa, Homo sapiens
  Native (PRAME_HUMAN)
LTHVLYPVPLESYEDIHGTL

SEQ ID NO: 345662 - protein, 21 aa, Homo sapiens
  Native (PRAME_HUMAN)
LTHVLYPVPLESYEDIHGTLH

SEQ ID NO: 345663 - protein, 22 aa, Homo sapiens
  Native (PRAME_HUMAN)
LTHVLYPVPLESYEDIHGTLHL

SEQ ID NO: 345664 - protein, 23 aa, Homo sapiens
  Native (PRAME_HUMAN)
LTHVLYPVPLESYEDIHGTLHLE

SEQ ID NO: 345665 - protein, 24 aa, Homo sapiens
  Native (PRAME_HUMAN)
LTHVLYPVPLESYEDIHGTLHLER

SEQ ID NO: 345666 - protein, 25 aa, Homo sapiens
  Native (PRAME_HUMAN)
LTHVLYPVPLESYEDIHGTLHLERL

SEQ ID NO: 345667 - protein, 13 aa, Homo sapiens
  Native (PRAME_HUMAN)
LTTLSFYGNSISI

SEQ ID NO: 345668 - protein, 14 aa, Homo sapiens
  Native (PRAME_HUMAN)
LTTLSFYGNSISIS

SEQ ID NO: 345669 - protein, 15 aa, Homo sapiens
  Native (PRAME_HUMAN)
LTTLSFYGNSISISA

SEQ ID NO: 345670 - protein, 16 aa, Homo sapiens
  Native (PRAME_HUMAN)
LTTLSFYGNSISISAL

SEQ ID NO: 345671 - protein, 17 aa, Homo sapiens
  Native (PRAME_HUMAN)
LTTLSFYGNSISISALQ

SEQ ID NO: 345672 - protein, 18 aa, Homo sapiens
  Native (PRAME_HUMAN)
LTTLSFYGNSISISALQS

SEQ ID NO: 345673 - protein, 19 aa, Homo sapiens
  Native (PRAME_HUMAN)
LTTLSFYGNSISISALQSL

SEQ ID NO: 345674 - protein, 20 aa, Homo sapiens
  Native (PRAME_HUMAN)
LTTLSFYGNSISISALQSLL

SEQ ID NO: 345675 - protein, 21 aa, Homo sapiens
  Native (PRAME_HUMAN)
LTTLSFYGNSISISALQSLLQ

SEQ ID NO: 345676 - protein, 22 aa, Homo sapiens
  Native (PRAME_HUMAN)
LTTLSFYGNSISISALQSLLQH

SEQ ID NO: 345677 - protein, 23 aa, Homo sapiens
  Native (PRAME_HUMAN)
LTTLSFYGNSISISALQSLLQHL

SEQ ID NO: 345678 - protein, 24 aa, Homo sapiens
  Native (PRAME_HUMAN)
LTTLSFYGNSISISALQSLLQHLI

SEQ ID NO: 345679 - protein, 25 aa, Homo sapiens
  Native (PRAME_HUMAN)
LTTLSFYGNSISISALQSLLQHLIG

SEQ ID NO: 345680 - protein, 15 aa, Homo sapiens
  Native (PRAME_HUMAN)
LVDLFLKEGACDELF

SEQ ID NO: 345681 - protein, 16 aa, Homo sapiens
  Native (PRAME_HUMAN)
LVDLFLKEGACDELFS

SEQ ID NO: 345682 - protein, 17 aa, Homo sapiens
  Native (PRAME_HUMAN)
LVDLFLKEGACDELFSY

SEQ ID NO: 345683 - protein, 18 aa, Homo sapiens
  Native (PRAME_HUMAN)
LVDLFLKEGACDELFSYL

SEQ ID NO: 345684 - protein, 19 aa, Homo sapiens
  Native (PRAME_HUMAN)
LVDLFLKEGACDELFSYLI

SEQ ID NO: 345685 - protein, 20 aa, Homo sapiens
  Native (PRAME_HUMAN)
LVDLFLKEGACDELFSYLIE

SEQ ID NO: 345686 - protein, 21 aa, Homo sapiens
  Native (PRAME_HUMAN)
LVDLFLKEGACDELFSYLIEK

SEQ ID NO: 345687 - protein, 22 aa, Homo sapiens
  Native (PRAME_HUMAN)
LVDLFLKEGACDELFSYLIEKV

SEQ ID NO: 345688 - protein, 23 aa, Homo sapiens
  Native (PRAME_HUMAN)
LVDLFLKEGACDELFSYLIEKVK

SEQ ID NO: 345689 - protein, 24 aa, Homo sapiens
  Native (PRAME_HUMAN)
LVDLFLKEGACDELFSYLIEKVKR

SEQ ID NO: 345690 - protein, 25 aa, Homo sapiens
  Native (PRAME_HUMAN)
LVDLFLKEGACDELFSYLIEKVKRK

SEQ ID NO: 345691 - protein, 13 aa, Homo sapiens
  Native (PRAME_HUMAN)
LVELAGQSLLKDE

SEQ ID NO: 345692 - protein, 14 aa, Homo sapiens
  Native (PRAME_HUMAN)
LVELAGQSLLKDEA

SEQ ID NO: 345693 - protein, 15 aa, Homo sapiens
  Native (PRAME_HUMAN)
LVELAGQSLLKDEAL

SEQ ID NO: 345694 - protein, 16 aa, Homo sapiens
  Native (PRAME_HUMAN)
LVELAGQSLLKDEALA

SEQ ID NO: 345695 - protein, 17 aa, Homo sapiens
  Native (PRAME_HUMAN)
LVELAGQSLLKDEALAI

SEQ ID NO: 345696 - protein, 18 aa, Homo sapiens
  Native (PRAME_HUMAN)
LVELAGQSLLKDEALAIA

SEQ ID NO: 345697 - protein, 19 aa, Homo sapiens
  Native (PRAME_HUMAN)
LVELAGQSLLKDEALAIAA

SEQ ID NO: 345698 - protein, 20 aa, Homo sapiens
  Native (PRAME_HUMAN)
LVELAGQSLLKDEALAIAAL

SEQ ID NO: 345699 - protein, 21 aa, Homo sapiens
  Native (PRAME_HUMAN)
LVELAGQSLLKDEALAIAALE

SEQ ID NO: 345700 - protein, 22 aa, Homo sapiens
  Native (PRAME_HUMAN)
LVELAGQSLLKDEALAIAALEL

SEQ ID NO: 345701 - protein, 23 aa, Homo sapiens
  Native (PRAME_HUMAN)
LVELAGQSLLKDEALAIAALELL

SEQ ID NO: 345702 - protein, 24 aa, Homo sapiens
  Native (PRAME_HUMAN)
LVELAGQSLLKDEALAIAALELLP

SEQ ID NO: 345703 - protein, 25 aa, Homo sapiens
  Native (PRAME_HUMAN)
LVELAGQSLLKDEALAIAALELLPR

SEQ ID NO: 345704 - protein, 16 aa, Homo sapiens
  Native (PRAME_HUMAN)
LVFDECGITDDQLLAL

SEQ ID NO: 345705 - protein, 17 aa, Homo sapiens
  Native (PRAME_HUMAN)
LVFDECGITDDQLLALL

SEQ ID NO: 345706 - protein, 18 aa, Homo sapiens
  Native (PRAME_HUMAN)
LVFDECGITDDQLLALLP

SEQ ID NO: 345707 - protein, 19 aa, Homo sapiens
  Native (PRAME_HUMAN)
LVFDECGITDDQLLALLPS

SEQ ID NO: 345708 - protein, 20 aa, Homo sapiens
  Native (PRAME_HUMAN)
LVFDECGITDDQLLALLPSL

SEQ ID NO: 345709 - protein, 21 aa, Homo sapiens
  Native (PRAME_HUMAN)
LVFDECGITDDQLLALLPSLS

SEQ ID NO: 345710 - protein, 22 aa, Homo sapiens
  Native (PRAME_HUMAN)
LVFDECGITDDQLLALLPSLSH

SEQ ID NO: 345711 - protein, 23 aa, Homo sapiens
  Native (PRAME_HUMAN)
LVFDECGITDDQLLALLPSLSHC

SEQ ID NO: 345712 - protein, 24 aa, Homo sapiens
  Native (PRAME_HUMAN)
LVFDECGITDDQLLALLPSLSHCS

SEQ ID NO: 345713 - protein, 25 aa, Homo sapiens
  Native (PRAME_HUMAN)
LVFDECGITDDQLLALLPSLSHCSQ

SEQ ID NO: 345714 - protein, 13 aa, Homo sapiens
  Native (PRAME_HUMAN)
LWGSIQSRYISMS

SEQ ID NO: 345715 - protein, 14 aa, Homo sapiens
  Native (PRAME_HUMAN)
LWGSIQSRYISMSV

SEQ ID NO: 345716 - protein, 15 aa, Homo sapiens
  Native (PRAME_HUMAN)
LWGSIQSRYISMSVW

SEQ ID NO: 345717 - protein, 16 aa, Homo sapiens
  Native (PRAME_HUMAN)
LWGSIQSRYISMSVWT

SEQ ID NO: 345718 - protein, 17 aa, Homo sapiens
  Native (PRAME_HUMAN)
LWGSIQSRYISMSVWTS

SEQ ID NO: 345719 - protein, 18 aa, Homo sapiens
  Native (PRAME_HUMAN)
LWGSIQSRYISMSVWTSP

SEQ ID NO: 345720 - protein, 19 aa, Homo sapiens
  Native (PRAME_HUMAN)
LWGSIQSRYISMSVWTSPR

SEQ ID NO: 345721 - protein, 20 aa, Homo sapiens
  Native (PRAME_HUMAN)
LWGSIQSRYISMSVWTSPRR

SEQ ID NO: 345722 - protein, 21 aa, Homo sapiens
  Native (PRAME_HUMAN)
LWGSIQSRYISMSVWTSPRRL

SEQ ID NO: 345723 - protein, 22 aa, Homo sapiens
  Native (PRAME_HUMAN)
LWGSIQSRYISMSVWTSPRRLV

SEQ ID NO: 345724 - protein, 23 aa, Homo sapiens
  Native (PRAME_HUMAN)
LWGSIQSRYISMSVWTSPRRLVE

SEQ ID NO: 345725 - protein, 24 aa, Homo sapiens
  Native (PRAME_HUMAN)
LWGSIQSRYISMSVWTSPRRLVEL

SEQ ID NO: 345726 - protein, 25 aa, Homo sapiens
  Native (PRAME_HUMAN)
LWGSIQSRYISMSVWTSPRRLVELA

SEQ ID NO: 345727 - protein, 14 aa, Homo sapiens
  Native (PRAME_HUMAN)
LYPVPLESYEDIHG

SEQ ID NO: 345728 - protein, 15 aa, Homo sapiens
  Native (PRAME_HUMAN)
LYPVPLESYEDIHGT

SEQ ID NO: 345729 - protein, 16 aa, Homo sapiens
  Native (PRAME_HUMAN)
LYPVPLESYEDIHGTL

SEQ ID NO: 345730 - protein, 17 aa, Homo sapiens
  Native (PRAME_HUMAN)
LYPVPLESYEDIHGTLH

SEQ ID NO: 345731 - protein, 18 aa, Homo sapiens
  Native (PRAME_HUMAN)
LYPVPLESYEDIHGTLHL

SEQ ID NO: 345732 - protein, 19 aa, Homo sapiens
  Native (PRAME_HUMAN)
LYPVPLESYEDIHGTLHLE

SEQ ID NO: 345733 - protein, 20 aa, Homo sapiens
  Native (PRAME_HUMAN)
LYPVPLESYEDIHGTLHLER

SEQ ID NO: 345734 - protein, 21 aa, Homo sapiens
  Native (PRAME_HUMAN)
LYPVPLESYEDIHGTLHLERL

SEQ ID NO: 345735 - protein, 22 aa, Homo sapiens
  Native (PRAME_HUMAN)
LYPVPLESYEDIHGTLHLERLA

SEQ ID NO: 345736 - protein, 23 aa, Homo sapiens
  Native (PRAME_HUMAN)
LYPVPLESYEDIHGTLHLERLAY

SEQ ID NO: 345737 - protein, 24 aa, Homo sapiens
  Native (PRAME_HUMAN)
LYPVPLESYEDIHGTLHLERLAYL

SEQ ID NO: 345738 - protein, 25 aa, Homo sapiens
  Native (PRAME_HUMAN)
LYPVPLESYEDIHGTLHLERLAYLH

SEQ ID NO: 345739 - protein, 15 aa, Homo sapiens
  Native (PRAME_HUMAN)
LYSFPEPEAAQPMTK

SEQ ID NO: 345740 - protein, 16 aa, Homo sapiens
  Native (PRAME_HUMAN)
LYSFPEPEAAQPMTKK

SEQ ID NO: 345741 - protein, 17 aa, Homo sapiens
  Native (PRAME_HUMAN)
LYSFPEPEAAQPMTKKR

SEQ ID NO: 345742 - protein, 19 aa, Homo sapiens
  Native (PRAME_HUMAN)
LYSFPEPEAAQPMTKKRKV

SEQ ID NO: 345743 - protein, 20 aa, Homo sapiens
  Native (PRAME_HUMAN)
LYSFPEPEAAQPMTKKRKVD

SEQ ID NO: 345744 - protein, 25 aa, Homo sapiens
  Native (PRAME_HUMAN)
LYSFPEPEAAQPMTKKRKVDGLSTE

SEQ ID NO: 345745 - protein, 13 aa, Homo sapiens
  Native (PRAME_HUMAN)
LYVDSLFFLRGRL

SEQ ID NO: 345746 - protein, 14 aa, Homo sapiens
  Native (PRAME_HUMAN)
LYVDSLFFLRGRLD

SEQ ID NO: 345747 - protein, 15 aa, Homo sapiens
  Native (PRAME_HUMAN)
LYVDSLFFLRGRLDQ

SEQ ID NO: 345748 - protein, 16 aa, Homo sapiens
  Native (PRAME_HUMAN)
LYVDSLFFLRGRLDQL

SEQ ID NO: 345749 - protein, 17 aa, Homo sapiens
  Native (PRAME_HUMAN)
LYVDSLFFLRGRLDQLL

SEQ ID NO: 345750 - protein, 18 aa, Homo sapiens
  Native (PRAME_HUMAN)
LYVDSLFFLRGRLDQLLR

SEQ ID NO: 345751 - protein, 19 aa, Homo sapiens
  Native (PRAME_HUMAN)
LYVDSLFFLRGRLDQLLRH

SEQ ID NO: 345752 - protein, 20 aa, Homo sapiens
  Native (PRAME_HUMAN)
LYVDSLFFLRGRLDQLLRHV

SEQ ID NO: 345753 - protein, 21 aa, Homo sapiens
  Native (PRAME_HUMAN)
LYVDSLFFLRGRLDQLLRHVM

SEQ ID NO: 345754 - protein, 22 aa, Homo sapiens
  Native (PRAME_HUMAN)
LYVDSLFFLRGRLDQLLRHVMN

SEQ ID NO: 345755 - protein, 23 aa, Homo sapiens
  Native (PRAME_HUMAN)
LYVDSLFFLRGRLDQLLRHVMNP

SEQ ID NO: 345756 - protein, 24 aa, Homo sapiens
  Native (PRAME_HUMAN)
LYVDSLFFLRGRLDQLLRHVMNPL

SEQ ID NO: 345757 - protein, 25 aa, Homo sapiens
  Native (PRAME_HUMAN)
LYVDSLFFLRGRLDQLLRHVMNPLE

SEQ ID NO: 345758 - protein, 15 aa, Homo sapiens
  Native (PRAME_HUMAN)
MAAFDGRHSQTLKAM

SEQ ID NO: 345759 - protein, 16 aa, Homo sapiens
  Native (PRAME_HUMAN)
MAAFDGRHSQTLKAMV

SEQ ID NO: 345760 - protein, 17 aa, Homo sapiens
  Native (PRAME_HUMAN)
MAAFDGRHSQTLKAMVQ

SEQ ID NO: 345761 - protein, 18 aa, Homo sapiens
  Native (PRAME_HUMAN)
MAAFDGRHSQTLKAMVQA

SEQ ID NO: 345762 - protein, 19 aa, Homo sapiens
  Native (PRAME_HUMAN)
MAAFDGRHSQTLKAMVQAW

SEQ ID NO: 345763 - protein, 20 aa, Homo sapiens
  Native (PRAME_HUMAN)
MAAFDGRHSQTLKAMVQAWP

SEQ ID NO: 345764 - protein, 21 aa, Homo sapiens
  Native (PRAME_HUMAN)
MAAFDGRHSQTLKAMVQAWPF

SEQ ID NO: 345765 - protein, 22 aa, Homo sapiens
  Native (PRAME_HUMAN)
MAAFDGRHSQTLKAMVQAWPFT

SEQ ID NO: 345766 - protein, 23 aa, Homo sapiens
  Native (PRAME_HUMAN)
MAAFDGRHSQTLKAMVQAWPFTC

SEQ ID NO: 345767 - protein, 24 aa, Homo sapiens
  Native (PRAME_HUMAN)
MAAFDGRHSQTLKAMVQAWPFTCL

SEQ ID NO: 345768 - protein, 25 aa, Homo sapiens
  Native (PRAME_HUMAN)
MAAFDGRHSQTLKAMVQAWPFTCLP

SEQ ID NO: 345769 - protein, 14 aa, Homo sapiens
  Native (PRAME_HUMAN)
MERRRLWGSIQSRY

SEQ ID NO: 345770 - protein, 15 aa, Homo sapiens
  Native (PRAME_HUMAN)
MERRRLWGSIQSRYI

SEQ ID NO: 345771 - protein, 16 aa, Homo sapiens
  Native (PRAME_HUMAN)
MERRRLWGSIQSRYIS

SEQ ID NO: 345772 - protein, 17 aa, Homo sapiens
  Native (PRAME_HUMAN)
MERRRLWGSIQSRYISM

SEQ ID NO: 345773 - protein, 18 aa, Homo sapiens
  Native (PRAME_HUMAN)
MERRRLWGSIQSRYISMS

SEQ ID NO: 345774 - protein, 19 aa, Homo sapiens
  Native (PRAME_HUMAN)
MERRRLWGSIQSRYISMSV

SEQ ID NO: 345775 - protein, 20 aa, Homo sapiens
  Native (PRAME_HUMAN)
MERRRLWGSIQSRYISMSVW

SEQ ID NO: 345776 - protein, 21 aa, Homo sapiens
  Native (PRAME_HUMAN)
MERRRLWGSIQSRYISMSVWT

SEQ ID NO: 345777 - protein, 22 aa, Homo sapiens
  Native (PRAME_HUMAN)
MERRRLWGSIQSRYISMSVWTS

SEQ ID NO: 345778 - protein, 23 aa, Homo sapiens
  Native (PRAME_HUMAN)
MERRRLWGSIQSRYISMSVWTSP

SEQ ID NO: 345779 - protein, 24 aa, Homo sapiens
  Native (PRAME_HUMAN)
MERRRLWGSIQSRYISMSVWTSPR

SEQ ID NO: 345780 - protein, 14 aa, Homo sapiens
  Native (PRAME_HUMAN)
MHLSQSPSVSQLSV

SEQ ID NO: 345781 - protein, 15 aa, Homo sapiens
  Native (PRAME_HUMAN)
MHLSQSPSVSQLSVL

SEQ ID NO: 345782 - protein, 16 aa, Homo sapiens
  Native (PRAME_HUMAN)
MHLSQSPSVSQLSVLS

SEQ ID NO: 345783 - protein, 17 aa, Homo sapiens
  Native (PRAME_HUMAN)
MHLSQSPSVSQLSVLSL

SEQ ID NO: 345784 - protein, 18 aa, Homo sapiens
  Native (PRAME_HUMAN)
MHLSQSPSVSQLSVLSLS

SEQ ID NO: 345785 - protein, 19 aa, Homo sapiens
  Native (PRAME_HUMAN)
MHLSQSPSVSQLSVLSLSG

SEQ ID NO: 345786 - protein, 20 aa, Homo sapiens
  Native (PRAME_HUMAN)
MHLSQSPSVSQLSVLSLSGV

SEQ ID NO: 345787 - protein, 21 aa, Homo sapiens
  Native (PRAME_HUMAN)
MHLSQSPSVSQLSVLSLSGVM

SEQ ID NO: 345788 - protein, 22 aa, Homo sapiens
  Native (PRAME_HUMAN)
MHLSQSPSVSQLSVLSLSGVML

SEQ ID NO: 345789 - protein, 23 aa, Homo sapiens
  Native (PRAME_HUMAN)
MHLSQSPSVSQLSVLSLSGVMLT

SEQ ID NO: 345790 - protein, 24 aa, Homo sapiens
  Native (PRAME_HUMAN)
MHLSQSPSVSQLSVLSLSGVMLTD

SEQ ID NO: 345791 - protein, 25 aa, Homo sapiens
  Native (PRAME_HUMAN)
MHLSQSPSVSQLSVLSLSGVMLTDV

SEQ ID NO: 345792 - protein, 13 aa, Homo sapiens
  Native (PRAME_HUMAN)
MILKMVQLDSIED

SEQ ID NO: 345793 - protein, 14 aa, Homo sapiens
  Native (PRAME_HUMAN)
MILKMVQLDSIEDL

SEQ ID NO: 345794 - protein, 15 aa, Homo sapiens
  Native (PRAME_HUMAN)
MILKMVQLDSIEDLE

SEQ ID NO: 345795 - protein, 16 aa, Homo sapiens
  Native (PRAME_HUMAN)
MILKMVQLDSIEDLEV

SEQ ID NO: 345796 - protein, 17 aa, Homo sapiens
  Native (PRAME_HUMAN)
MILKMVQLDSIEDLEVT

SEQ ID NO: 345797 - protein, 18 aa, Homo sapiens
  Native (PRAME_HUMAN)
MILKMVQLDSIEDLEVTC

SEQ ID NO: 345798 - protein, 19 aa, Homo sapiens
  Native (PRAME_HUMAN)
MILKMVQLDSIEDLEVTCT

SEQ ID NO: 345799 - protein, 20 aa, Homo sapiens
  Native (PRAME_HUMAN)
MILKMVQLDSIEDLEVTCTW

SEQ ID NO: 345800 - protein, 21 aa, Homo sapiens
  Native (PRAME_HUMAN)
MILKMVQLDSIEDLEVTCTWK

SEQ ID NO: 345801 - protein, 22 aa, Homo sapiens
  Native (PRAME_HUMAN)
MILKMVQLDSIEDLEVTCTWKL

SEQ ID NO: 345802 - protein, 23 aa, Homo sapiens
  Native (PRAME_HUMAN)
MILKMVQLDSIEDLEVTCTWKLP

SEQ ID NO: 345803 - protein, 24 aa, Homo sapiens
  Native (PRAME_HUMAN)
MILKMVQLDSIEDLEVTCTWKLPT

SEQ ID NO: 345804 - protein, 25 aa, Homo sapiens
  Native (PRAME_HUMAN)
MILKMVQLDSIEDLEVTCTWKLPTL

SEQ ID NO: 345805 - protein, 13 aa, Homo sapiens
  Native (PRAME_HUMAN)
MINLRRLLLSHIH

SEQ ID NO: 345806 - protein, 14 aa, Homo sapiens
  Native (PRAME_HUMAN)
MINLRRLLLSHIHA

SEQ ID NO: 345807 - protein, 15 aa, Homo sapiens
  Native (PRAME_HUMAN)
MINLRRLLLSHIHAS

SEQ ID NO: 345808 - protein, 16 aa, Homo sapiens
  Native (PRAME_HUMAN)
MINLRRLLLSHIHASS

SEQ ID NO: 345809 - protein, 17 aa, Homo sapiens
  Native (PRAME_HUMAN)
MINLRRLLLSHIHASSY

SEQ ID NO: 345810 - protein, 18 aa, Homo sapiens
  Native (PRAME_HUMAN)
MINLRRLLLSHIHASSYI

SEQ ID NO: 345811 - protein, 19 aa, Homo sapiens
  Native (PRAME_HUMAN)
MINLRRLLLSHIHASSYIS

SEQ ID NO: 345812 - protein, 20 aa, Homo sapiens
  Native (PRAME_HUMAN)
MINLRRLLLSHIHASSYISP

SEQ ID NO: 345813 - protein, 21 aa, Homo sapiens
  Native (PRAME_HUMAN)
MINLRRLLLSHIHASSYISPE

SEQ ID NO: 345814 - protein, 22 aa, Homo sapiens
  Native (PRAME_HUMAN)
MINLRRLLLSHIHASSYISPEK

SEQ ID NO: 345815 - protein, 23 aa, Homo sapiens
  Native (PRAME_HUMAN)
MINLRRLLLSHIHASSYISPEKE

SEQ ID NO: 345816 - protein, 24 aa, Homo sapiens
  Native (PRAME_HUMAN)
MINLRRLLLSHIHASSYISPEKEE

SEQ ID NO: 345817 - protein, 25 aa, Homo sapiens
  Native (PRAME_HUMAN)
MINLRRLLLSHIHASSYISPEKEEQ

SEQ ID NO: 345818 - protein, 14 aa, Homo sapiens
  Native (PRAME_HUMAN)
MKGQHLHLETFKAV

SEQ ID NO: 345819 - protein, 15 aa, Homo sapiens
  Native (PRAME_HUMAN)
MKGQHLHLETFKAVL

SEQ ID NO: 345820 - protein, 16 aa, Homo sapiens
  Native (PRAME_HUMAN)
MKGQHLHLETFKAVLD

SEQ ID NO: 345821 - protein, 17 aa, Homo sapiens
  Native (PRAME_HUMAN)
MKGQHLHLETFKAVLDG

SEQ ID NO: 345822 - protein, 18 aa, Homo sapiens
  Native (PRAME_HUMAN)
MKGQHLHLETFKAVLDGL

SEQ ID NO: 345823 - protein, 19 aa, Homo sapiens
  Native (PRAME_HUMAN)
MKGQHLHLETFKAVLDGLD

SEQ ID NO: 345824 - protein, 20 aa, Homo sapiens
  Native (PRAME_HUMAN)
MKGQHLHLETFKAVLDGLDV

SEQ ID NO: 345825 - protein, 21 aa, Homo sapiens
  Native (PRAME_HUMAN)
MKGQHLHLETFKAVLDGLDVL

SEQ ID NO: 345826 - protein, 22 aa, Homo sapiens
  Native (PRAME_HUMAN)
MKGQHLHLETFKAVLDGLDVLL

SEQ ID NO: 345827 - protein, 23 aa, Homo sapiens
  Native (PRAME_HUMAN)
MKGQHLHLETFKAVLDGLDVLLA

SEQ ID NO: 345828 - protein, 24 aa, Homo sapiens
  Native (PRAME_HUMAN)
MKGQHLHLETFKAVLDGLDVLLAQ

SEQ ID NO: 345829 - protein, 25 aa, Homo sapiens
  Native (PRAME_HUMAN)
MKGQHLHLETFKAVLDGLDVLLAQE

SEQ ID NO: 345830 - protein, 14 aa, Homo sapiens
  Native (PRAME_HUMAN)
MLTDVSPEPLQALL

SEQ ID NO: 345831 - protein, 15 aa, Homo sapiens
  Native (PRAME_HUMAN)
MLTDVSPEPLQALLE

SEQ ID NO: 345832 - protein, 16 aa, Homo sapiens
  Native (PRAME_HUMAN)
MLTDVSPEPLQALLER

SEQ ID NO: 345833 - protein, 17 aa, Homo sapiens
  Native (PRAME_HUMAN)
MLTDVSPEPLQALLERA

SEQ ID NO: 345834 - protein, 18 aa, Homo sapiens
  Native (PRAME_HUMAN)
MLTDVSPEPLQALLERAS

SEQ ID NO: 345835 - protein, 19 aa, Homo sapiens
  Native (PRAME_HUMAN)
MLTDVSPEPLQALLERASA

SEQ ID NO: 345836 - protein, 20 aa, Homo sapiens
  Native (PRAME_HUMAN)
MLTDVSPEPLQALLERASAT

SEQ ID NO: 345837 - protein, 21 aa, Homo sapiens
  Native (PRAME_HUMAN)
MLTDVSPEPLQALLERASATL

SEQ ID NO: 345838 - protein, 22 aa, Homo sapiens
  Native (PRAME_HUMAN)
MLTDVSPEPLQALLERASATLQ

SEQ ID NO: 345839 - protein, 23 aa, Homo sapiens
  Native (PRAME_HUMAN)
MLTDVSPEPLQALLERASATLQD

SEQ ID NO: 345840 - protein, 24 aa, Homo sapiens
  Native (PRAME_HUMAN)
MLTDVSPEPLQALLERASATLQDL

SEQ ID NO: 345841 - protein, 25 aa, Homo sapiens
  Native (PRAME_HUMAN)
MLTDVSPEPLQALLERASATLQDLV

SEQ ID NO: 345842 - protein, 15 aa, Homo sapiens
  Native (PRAME_HUMAN)
MNPLETLSITNCRLS

SEQ ID NO: 345843 - protein, 16 aa, Homo sapiens
  Native (PRAME_HUMAN)
MNPLETLSITNCRLSE

SEQ ID NO: 345844 - protein, 17 aa, Homo sapiens
  Native (PRAME_HUMAN)
MNPLETLSITNCRLSEG

SEQ ID NO: 345845 - protein, 19 aa, Homo sapiens
  Native (PRAME_HUMAN)
MNPLETLSITNCRLSEGDV

SEQ ID NO: 345846 - protein, 20 aa, Homo sapiens
  Native (PRAME_HUMAN)
MNPLETLSITNCRLSEGDVM

SEQ ID NO: 345847 - protein, 21 aa, Homo sapiens
  Native (PRAME_HUMAN)
MNPLETLSITNCRLSEGDVMH

SEQ ID NO: 345848 - protein, 22 aa, Homo sapiens
  Native (PRAME_HUMAN)
MNPLETLSITNCRLSEGDVMHL

SEQ ID NO: 345849 - protein, 23 aa, Homo sapiens
  Native (PRAME_HUMAN)
MNPLETLSITNCRLSEGDVMHLS

SEQ ID NO: 345850 - protein, 24 aa, Homo sapiens
  Native (PRAME_HUMAN)
MNPLETLSITNCRLSEGDVMHLSQ

SEQ ID NO: 345851 - protein, 25 aa, Homo sapiens
  Native (PRAME_HUMAN)
MNPLETLSITNCRLSEGDVMHLSQS

SEQ ID NO: 345852 - protein, 14 aa, Homo sapiens
  Native (PRAME_HUMAN)
MPMQDIKMILKMVQ

SEQ ID NO: 345853 - protein, 15 aa, Homo sapiens
  Native (PRAME_HUMAN)
MPMQDIKMILKMVQL

SEQ ID NO: 345854 - protein, 16 aa, Homo sapiens
  Native (PRAME_HUMAN)
MPMQDIKMILKMVQLD

SEQ ID NO: 345855 - protein, 17 aa, Homo sapiens
  Native (PRAME_HUMAN)
MPMQDIKMILKMVQLDS

SEQ ID NO: 345856 - protein, 18 aa, Homo sapiens
  Native (PRAME_HUMAN)
MPMQDIKMILKMVQLDSI

SEQ ID NO: 345857 - protein, 19 aa, Homo sapiens
  Native (PRAME_HUMAN)
MPMQDIKMILKMVQLDSIE

SEQ ID NO: 345858 - protein, 20 aa, Homo sapiens
  Native (PRAME_HUMAN)
MPMQDIKMILKMVQLDSIED

SEQ ID NO: 345859 - protein, 21 aa, Homo sapiens
  Native (PRAME_HUMAN)
MPMQDIKMILKMVQLDSIEDL

SEQ ID NO: 345860 - protein, 22 aa, Homo sapiens
  Native (PRAME_HUMAN)
MPMQDIKMILKMVQLDSIEDLE

SEQ ID NO: 345861 - protein, 23 aa, Homo sapiens
  Native (PRAME_HUMAN)
MPMQDIKMILKMVQLDSIEDLEV

SEQ ID NO: 345862 - protein, 24 aa, Homo sapiens
  Native (PRAME_HUMAN)
MPMQDIKMILKMVQLDSIEDLEVT

SEQ ID NO: 345863 - protein, 25 aa, Homo sapiens
  Native (PRAME_HUMAN)
MPMQDIKMILKMVQLDSIEDLEVTC

SEQ ID NO: 345864 - protein, 13 aa, Homo sapiens
  Native (PRAME_HUMAN)
MQDIKMILKMVQL

SEQ ID NO: 345865 - protein, 14 aa, Homo sapiens
  Native (PRAME_HUMAN)
MQDIKMILKMVQLD

SEQ ID NO: 345866 - protein, 15 aa, Homo sapiens
  Native (PRAME_HUMAN)
MQDIKMILKMVQLDS

SEQ ID NO: 345867 - protein, 16 aa, Homo sapiens
  Native (PRAME_HUMAN)
MQDIKMILKMVQLDSI

SEQ ID NO: 345868 - protein, 17 aa, Homo sapiens
  Native (PRAME_HUMAN)
MQDIKMILKMVQLDSIE

SEQ ID NO: 345869 - protein, 18 aa, Homo sapiens
  Native (PRAME_HUMAN)
MQDIKMILKMVQLDSIED

SEQ ID NO: 345870 - protein, 19 aa, Homo sapiens
  Native (PRAME_HUMAN)
MQDIKMILKMVQLDSIEDL

SEQ ID NO: 345871 - protein, 20 aa, Homo sapiens
  Native (PRAME_HUMAN)
MQDIKMILKMVQLDSIEDLE

SEQ ID NO: 345872 - protein, 21 aa, Homo sapiens
  Native (PRAME_HUMAN)
MQDIKMILKMVQLDSIEDLEV

SEQ ID NO: 345873 - protein, 22 aa, Homo sapiens
  Native (PRAME_HUMAN)
MQDIKMILKMVQLDSIEDLEVT

SEQ ID NO: 345874 - protein, 23 aa, Homo sapiens
  Native (PRAME_HUMAN)
MQDIKMILKMVQLDSIEDLEVTC

SEQ ID NO: 345875 - protein, 24 aa, Homo sapiens
  Native (PRAME_HUMAN)
MQDIKMILKMVQLDSIEDLEVTCT

SEQ ID NO: 345876 - protein, 25 aa, Homo sapiens
  Native (PRAME_HUMAN)
MQDIKMILKMVQLDSIEDLEVTCTW

SEQ ID NO: 345877 - protein, 13 aa, Homo sapiens
  Native (PRAME_HUMAN)
MSVWTSPRRLVEL

SEQ ID NO: 345878 - protein, 14 aa, Homo sapiens
  Native (PRAME_HUMAN)
MSVWTSPRRLVELA

SEQ ID NO: 345879 - protein, 15 aa, Homo sapiens
  Native (PRAME_HUMAN)
MSVWTSPRRLVELAG

SEQ ID NO: 345880 - protein, 16 aa, Homo sapiens
  Native (PRAME_HUMAN)
MSVWTSPRRLVELAGQ

SEQ ID NO: 345881 - protein, 17 aa, Homo sapiens
  Native (PRAME_HUMAN)
MSVWTSPRRLVELAGQS

SEQ ID NO: 345882 - protein, 18 aa, Homo sapiens
  Native (PRAME_HUMAN)
MSVWTSPRRLVELAGQSL

SEQ ID NO: 345883 - protein, 19 aa, Homo sapiens
  Native (PRAME_HUMAN)
MSVWTSPRRLVELAGQSLL

SEQ ID NO: 345884 - protein, 20 aa, Homo sapiens
  Native (PRAME_HUMAN)
MSVWTSPRRLVELAGQSLLK

SEQ ID NO: 345885 - protein, 21 aa, Homo sapiens
  Native (PRAME_HUMAN)
MSVWTSPRRLVELAGQSLLKD

SEQ ID NO: 345886 - protein, 22 aa, Homo sapiens
  Native (PRAME_HUMAN)
MSVWTSPRRLVELAGQSLLKDE

SEQ ID NO: 345887 - protein, 23 aa, Homo sapiens
  Native (PRAME_HUMAN)
MSVWTSPRRLVELAGQSLLKDEA

SEQ ID NO: 345888 - protein, 24 aa, Homo sapiens
  Native (PRAME_HUMAN)
MSVWTSPRRLVELAGQSLLKDEAL

SEQ ID NO: 345889 - protein, 25 aa, Homo sapiens
  Native (PRAME_HUMAN)
MSVWTSPRRLVELAGQSLLKDEALA

SEQ ID NO: 345890 - protein, 18 aa, Homo sapiens
  Native (PRAME_HUMAN)
MTKKRKVDGLSTEAEQPF

SEQ ID NO: 345891 - protein, 19 aa, Homo sapiens
  Native (PRAME_HUMAN)
MTKKRKVDGLSTEAEQPFI

SEQ ID NO: 345892 - protein, 20 aa, Homo sapiens
  Native (PRAME_HUMAN)
MTKKRKVDGLSTEAEQPFIP

SEQ ID NO: 345893 - protein, 21 aa, Homo sapiens
  Native (PRAME_HUMAN)
MTKKRKVDGLSTEAEQPFIPV

SEQ ID NO: 345894 - protein, 22 aa, Homo sapiens
  Native (PRAME_HUMAN)
MTKKRKVDGLSTEAEQPFIPVE

SEQ ID NO: 345895 - protein, 23 aa, Homo sapiens
  Native (PRAME_HUMAN)
MTKKRKVDGLSTEAEQPFIPVEV

SEQ ID NO: 345896 - protein, 24 aa, Homo sapiens
  Native (PRAME_HUMAN)
MTKKRKVDGLSTEAEQPFIPVEVL

SEQ ID NO: 345897 - protein, 25 aa, Homo sapiens
  Native (PRAME_HUMAN)
MTKKRKVDGLSTEAEQPFIPVEVLV

SEQ ID NO: 345898 - protein, 13 aa, Homo sapiens
  Native (PRAME_HUMAN)
MVQAWPFTCLPLG

SEQ ID NO: 345899 - protein, 14 aa, Homo sapiens
  Native (PRAME_HUMAN)
MVQAWPFTCLPLGV

SEQ ID NO: 345900 - protein, 15 aa, Homo sapiens
  Native (PRAME_HUMAN)
MVQAWPFTCLPLGVL

SEQ ID NO: 345901 - protein, 16 aa, Homo sapiens
  Native (PRAME_HUMAN)
MVQAWPFTCLPLGVLM

SEQ ID NO: 345902 - protein, 17 aa, Homo sapiens
  Native (PRAME_HUMAN)
MVQAWPFTCLPLGVLMK

SEQ ID NO: 345903 - protein, 18 aa, Homo sapiens
  Native (PRAME_HUMAN)
MVQAWPFTCLPLGVLMKG

SEQ ID NO: 345904 - protein, 19 aa, Homo sapiens
  Native (PRAME_HUMAN)
MVQAWPFTCLPLGVLMKGQ

SEQ ID NO: 345905 - protein, 20 aa, Homo sapiens
  Native (PRAME_HUMAN)
MVQAWPFTCLPLGVLMKGQH

SEQ ID NO: 345906 - protein, 21 aa, Homo sapiens
  Native (PRAME_HUMAN)
MVQAWPFTCLPLGVLMKGQHL

SEQ ID NO: 345907 - protein, 22 aa, Homo sapiens
  Native (PRAME_HUMAN)
MVQAWPFTCLPLGVLMKGQHLH

SEQ ID NO: 345908 - protein, 23 aa, Homo sapiens
  Native (PRAME_HUMAN)
MVQAWPFTCLPLGVLMKGQHLHL

SEQ ID NO: 345909 - protein, 24 aa, Homo sapiens
  Native (PRAME_HUMAN)
MVQAWPFTCLPLGVLMKGQHLHLE

SEQ ID NO: 345910 - protein, 25 aa, Homo sapiens
  Native (PRAME_HUMAN)
MVQAWPFTCLPLGVLMKGQHLHLET

SEQ ID NO: 345911 - protein, 13 aa, Homo sapiens
  Native (PRAME_HUMAN)
MVQLDSIEDLEVT

SEQ ID NO: 345912 - protein, 14 aa, Homo sapiens
  Native (PRAME_HUMAN)
MVQLDSIEDLEVTC

SEQ ID NO: 345913 - protein, 15 aa, Homo sapiens
  Native (PRAME_HUMAN)
MVQLDSIEDLEVTCT

SEQ ID NO: 345914 - protein, 16 aa, Homo sapiens
  Native (PRAME_HUMAN)
MVQLDSIEDLEVTCTW

SEQ ID NO: 345915 - protein, 17 aa, Homo sapiens
  Native (PRAME_HUMAN)
MVQLDSIEDLEVTCTWK

SEQ ID NO: 345916 - protein, 18 aa, Homo sapiens
  Native (PRAME_HUMAN)
MVQLDSIEDLEVTCTWKL

SEQ ID NO: 345917 - protein, 19 aa, Homo sapiens
  Native (PRAME_HUMAN)
MVQLDSIEDLEVTCTWKLP

SEQ ID NO: 345918 - protein, 20 aa, Homo sapiens
  Native (PRAME_HUMAN)
MVQLDSIEDLEVTCTWKLPT

SEQ ID NO: 345919 - protein, 21 aa, Homo sapiens
  Native (PRAME_HUMAN)
MVQLDSIEDLEVTCTWKLPTL

SEQ ID NO: 345920 - protein, 22 aa, Homo sapiens
  Native (PRAME_HUMAN)
MVQLDSIEDLEVTCTWKLPTLA

SEQ ID NO: 345921 - protein, 23 aa, Homo sapiens
  Native (PRAME_HUMAN)
MVQLDSIEDLEVTCTWKLPTLAK

SEQ ID NO: 345922 - protein, 24 aa, Homo sapiens
  Native (PRAME_HUMAN)
MVQLDSIEDLEVTCTWKLPTLAKF

SEQ ID NO: 345923 - protein, 25 aa, Homo sapiens
  Native (PRAME_HUMAN)
MVQLDSIEDLEVTCTWKLPTLAKFS

SEQ ID NO: 345924 - protein, 15 aa, Homo sapiens
  Native (PRAME_HUMAN)
MVWLSANPCPHCGDR

SEQ ID NO: 345925 - protein, 16 aa, Homo sapiens
  Native (PRAME_HUMAN)
MVWLSANPCPHCGDRT

SEQ ID NO: 345926 - protein, 19 aa, Homo sapiens
  Native (PRAME_HUMAN)
NCRLSEGDVMHLSQSPSVS

SEQ ID NO: 345927 - protein, 20 aa, Homo sapiens
  Native (PRAME_HUMAN)
NCRLSEGDVMHLSQSPSVSQ

SEQ ID NO: 345928 - protein, 21 aa, Homo sapiens
  Native (PRAME_HUMAN)
NCRLSEGDVMHLSQSPSVSQL

SEQ ID NO: 345929 - protein, 22 aa, Homo sapiens
  Native (PRAME_HUMAN)
NCRLSEGDVMHLSQSPSVSQLS

SEQ ID NO: 345930 - protein, 23 aa, Homo sapiens
  Native (PRAME_HUMAN)
NCRLSEGDVMHLSQSPSVSQLSV

SEQ ID NO: 345931 - protein, 24 aa, Homo sapiens
  Native (PRAME_HUMAN)
NCRLSEGDVMHLSQSPSVSQLSVL

SEQ ID NO: 345932 - protein, 25 aa, Homo sapiens
  Native (PRAME_HUMAN)
NCRLSEGDVMHLSQSPSVSQLSVLS

SEQ ID NO: 345933 - protein, 13 aa, Homo sapiens
  Native (PRAME_HUMAN)
NLRRLLLSHIHAS

SEQ ID NO: 345934 - protein, 14 aa, Homo sapiens
  Native (PRAME_HUMAN)
NLRRLLLSHIHASS

SEQ ID NO: 345935 - protein, 15 aa, Homo sapiens
  Native (PRAME_HUMAN)
NLRRLLLSHIHASSY

SEQ ID NO: 345936 - protein, 16 aa, Homo sapiens
  Native (PRAME_HUMAN)
NLRRLLLSHIHASSYI

SEQ ID NO: 345937 - protein, 17 aa, Homo sapiens
  Native (PRAME_HUMAN)
NLRRLLLSHIHASSYIS

SEQ ID NO: 345938 - protein, 18 aa, Homo sapiens
  Native (PRAME_HUMAN)
NLRRLLLSHIHASSYISP

SEQ ID NO: 345939 - protein, 19 aa, Homo sapiens
  Native (PRAME_HUMAN)
NLRRLLLSHIHASSYISPE

SEQ ID NO: 345940 - protein, 20 aa, Homo sapiens
  Native (PRAME_HUMAN)
NLRRLLLSHIHASSYISPEK

SEQ ID NO: 345941 - protein, 21 aa, Homo sapiens
  Native (PRAME_HUMAN)
NLRRLLLSHIHASSYISPEKE

SEQ ID NO: 345942 - protein, 22 aa, Homo sapiens
  Native (PRAME_HUMAN)
NLRRLLLSHIHASSYISPEKEE

SEQ ID NO: 345943 - protein, 23 aa, Homo sapiens
  Native (PRAME_HUMAN)
NLRRLLLSHIHASSYISPEKEEQ

SEQ ID NO: 345944 - protein, 24 aa, Homo sapiens
  Native (PRAME_HUMAN)
NLRRLLLSHIHASSYISPEKEEQY

SEQ ID NO: 345945 - protein, 25 aa, Homo sapiens
  Native (PRAME_HUMAN)
NLRRLLLSHIHASSYISPEKEEQYI

SEQ ID NO: 345946 - protein, 13 aa, Homo sapiens
  Native (PRAME_HUMAN)
NLTHVLYPVPLES

SEQ ID NO: 345947 - protein, 14 aa, Homo sapiens
  Native (PRAME_HUMAN)
NLTHVLYPVPLESY

SEQ ID NO: 345948 - protein, 15 aa, Homo sapiens
  Native (PRAME_HUMAN)
NLTHVLYPVPLESYE

SEQ ID NO: 345949 - protein, 16 aa, Homo sapiens
  Native (PRAME_HUMAN)
NLTHVLYPVPLESYED

SEQ ID NO: 345950 - protein, 17 aa, Homo sapiens
  Native (PRAME_HUMAN)
NLTHVLYPVPLESYEDI

SEQ ID NO: 345951 - protein, 18 aa, Homo sapiens
  Native (PRAME_HUMAN)
NLTHVLYPVPLESYEDIH

SEQ ID NO: 345952 - protein, 19 aa, Homo sapiens
  Native (PRAME_HUMAN)
NLTHVLYPVPLESYEDIHG

SEQ ID NO: 345953 - protein, 20 aa, Homo sapiens
  Native (PRAME_HUMAN)
NLTHVLYPVPLESYEDIHGT

SEQ ID NO: 345954 - protein, 21 aa, Homo sapiens
  Native (PRAME_HUMAN)
NLTHVLYPVPLESYEDIHGTL

SEQ ID NO: 345955 - protein, 22 aa, Homo sapiens
  Native (PRAME_HUMAN)
NLTHVLYPVPLESYEDIHGTLH

SEQ ID NO: 345956 - protein, 23 aa, Homo sapiens
  Native (PRAME_HUMAN)
NLTHVLYPVPLESYEDIHGTLHL

SEQ ID NO: 345957 - protein, 24 aa, Homo sapiens
  Native (PRAME_HUMAN)
NLTHVLYPVPLESYEDIHGTLHLE

SEQ ID NO: 345958 - protein, 25 aa, Homo sapiens
  Native (PRAME_HUMAN)
NLTHVLYPVPLESYEDIHGTLHLER

SEQ ID NO: 345959 - protein, 25 aa, Homo sapiens
  Native (PRAME_HUMAN)
NPCPHCGDRTFYDPEPILCPCFMPN

SEQ ID NO: 345960 - protein, 14 aa, Homo sapiens
  Native (PRAME_HUMAN)
NPLETLSITNCRLS

SEQ ID NO: 345961 - protein, 15 aa, Homo sapiens
  Native (PRAME_HUMAN)
NPLETLSITNCRLSE

SEQ ID NO: 345962 - protein, 16 aa, Homo sapiens
  Native (PRAME_HUMAN)
NPLETLSITNCRLSEG

SEQ ID NO: 345963 - protein, 17 aa, Homo sapiens
  Native (PRAME_HUMAN)
NPLETLSITNCRLSEGD

SEQ ID NO: 345964 - protein, 19 aa, Homo sapiens
  Native (PRAME_HUMAN)
NPLETLSITNCRLSEGDVM

SEQ ID NO: 345965 - protein, 20 aa, Homo sapiens
  Native (PRAME_HUMAN)
NPLETLSITNCRLSEGDVMH

SEQ ID NO: 345966 - protein, 21 aa, Homo sapiens
  Native (PRAME_HUMAN)
NPLETLSITNCRLSEGDVMHL

SEQ ID NO: 345967 - protein, 22 aa, Homo sapiens
  Native (PRAME_HUMAN)
NPLETLSITNCRLSEGDVMHLS

SEQ ID NO: 345968 - protein, 23 aa, Homo sapiens
  Native (PRAME_HUMAN)
NPLETLSITNCRLSEGDVMHLSQ

SEQ ID NO: 345969 - protein, 24 aa, Homo sapiens
  Native (PRAME_HUMAN)
NPLETLSITNCRLSEGDVMHLSQS

SEQ ID NO: 345970 - protein, 25 aa, Homo sapiens
  Native (PRAME_HUMAN)
NPLETLSITNCRLSEGDVMHLSQSP

SEQ ID NO: 345971 - protein, 14 aa, Homo sapiens
  Native (PRAME_HUMAN)
NRASLYSFPEPEAA

SEQ ID NO: 345972 - protein, 15 aa, Homo sapiens
  Native (PRAME_HUMAN)
NRASLYSFPEPEAAQ

SEQ ID NO: 345973 - protein, 16 aa, Homo sapiens
  Native (PRAME_HUMAN)
NRASLYSFPEPEAAQP

SEQ ID NO: 345974 - protein, 17 aa, Homo sapiens
  Native (PRAME_HUMAN)
NRASLYSFPEPEAAQPM

SEQ ID NO: 345975 - protein, 19 aa, Homo sapiens
  Native (PRAME_HUMAN)
NRASLYSFPEPEAAQPMTK

SEQ ID NO: 345976 - protein, 20 aa, Homo sapiens
  Native (PRAME_HUMAN)
NRASLYSFPEPEAAQPMTKK

SEQ ID NO: 345977 - protein, 21 aa, Homo sapiens
  Native (PRAME_HUMAN)
NRASLYSFPEPEAAQPMTKKR

SEQ ID NO: 345978 - protein, 22 aa, Homo sapiens
  Native (PRAME_HUMAN)
NRASLYSFPEPEAAQPMTKKRK

SEQ ID NO: 345979 - protein, 23 aa, Homo sapiens
  Native (PRAME_HUMAN)
NRASLYSFPEPEAAQPMTKKRKV

SEQ ID NO: 345980 - protein, 24 aa, Homo sapiens
  Native (PRAME_HUMAN)
NRASLYSFPEPEAAQPMTKKRKVD

SEQ ID NO: 345981 - protein, 25 aa, Homo sapiens
  Native (PRAME_HUMAN)
NRASLYSFPEPEAAQPMTKKRKVDG

SEQ ID NO: 345982 - protein, 15 aa, Homo sapiens
  Native (PRAME_HUMAN)
NSHQDFWTVWSGNRA

SEQ ID NO: 345983 - protein, 16 aa, Homo sapiens
  Native (PRAME_HUMAN)
NSHQDFWTVWSGNRAS

SEQ ID NO: 345984 - protein, 17 aa, Homo sapiens
  Native (PRAME_HUMAN)
NSHQDFWTVWSGNRASL

SEQ ID NO: 345985 - protein, 18 aa, Homo sapiens
  Native (PRAME_HUMAN)
NSHQDFWTVWSGNRASLY

SEQ ID NO: 345986 - protein, 19 aa, Homo sapiens
  Native (PRAME_HUMAN)
NSHQDFWTVWSGNRASLYS

SEQ ID NO: 345987 - protein, 20 aa, Homo sapiens
  Native (PRAME_HUMAN)
NSHQDFWTVWSGNRASLYSF

SEQ ID NO: 345988 - protein, 21 aa, Homo sapiens
  Native (PRAME_HUMAN)
NSHQDFWTVWSGNRASLYSFP

SEQ ID NO: 345989 - protein, 22 aa, Homo sapiens
  Native (PRAME_HUMAN)
NSHQDFWTVWSGNRASLYSFPE

SEQ ID NO: 345990 - protein, 23 aa, Homo sapiens
  Native (PRAME_HUMAN)
NSHQDFWTVWSGNRASLYSFPEP

SEQ ID NO: 345991 - protein, 24 aa, Homo sapiens
  Native (PRAME_HUMAN)
NSHQDFWTVWSGNRASLYSFPEPE

SEQ ID NO: 345992 - protein, 25 aa, Homo sapiens
  Native (PRAME_HUMAN)
NSHQDFWTVWSGNRASLYSFPEPEA

SEQ ID NO: 345993 - protein, 13 aa, Homo sapiens
  Native (PRAME_HUMAN)
NSISISALQSLLQ

SEQ ID NO: 345994 - protein, 14 aa, Homo sapiens
  Native (PRAME_HUMAN)
NSISISALQSLLQH

SEQ ID NO: 345995 - protein, 15 aa, Homo sapiens
  Native (PRAME_HUMAN)
NSISISALQSLLQHL

SEQ ID NO: 345996 - protein, 16 aa, Homo sapiens
  Native (PRAME_HUMAN)
NSISISALQSLLQHLI

SEQ ID NO: 345997 - protein, 17 aa, Homo sapiens
  Native (PRAME_HUMAN)
NSISISALQSLLQHLIG

SEQ ID NO: 345998 - protein, 18 aa, Homo sapiens
  Native (PRAME_HUMAN)
NSISISALQSLLQHLIGL

SEQ ID NO: 345999 - protein, 19 aa, Homo sapiens
  Native (PRAME_HUMAN)
NSISISALQSLLQHLIGLS

SEQ ID NO: 346000 - protein, 20 aa, Homo sapiens
  Native (PRAME_HUMAN)
NSISISALQSLLQHLIGLSN

SEQ ID NO: 346001 - protein, 21 aa, Homo sapiens
  Native (PRAME_HUMAN)
NSISISALQSLLQHLIGLSNL

SEQ ID NO: 346002 - protein, 22 aa, Homo sapiens
  Native (PRAME_HUMAN)
NSISISALQSLLQHLIGLSNLT

SEQ ID NO: 346003 - protein, 23 aa, Homo sapiens
  Native (PRAME_HUMAN)
NSISISALQSLLQHLIGLSNLTH

SEQ ID NO: 346004 - protein, 24 aa, Homo sapiens
  Native (PRAME_HUMAN)
NSISISALQSLLQHLIGLSNLTHV

SEQ ID NO: 346005 - protein, 25 aa, Homo sapiens
  Native (PRAME_HUMAN)
NSISISALQSLLQHLIGLSNLTHVL

SEQ ID NO: 346006 - protein, 13 aa, Homo sapiens
  Native (PRAME_HUMAN)
NVLRLCCKKLKIF

SEQ ID NO: 346007 - protein, 14 aa, Homo sapiens
  Native (PRAME_HUMAN)
NVLRLCCKKLKIFA

SEQ ID NO: 346008 - protein, 15 aa, Homo sapiens
  Native (PRAME_HUMAN)
NVLRLCCKKLKIFAM

SEQ ID NO: 346009 - protein, 16 aa, Homo sapiens
  Native (PRAME_HUMAN)
NVLRLCCKKLKIFAMP

SEQ ID NO: 346010 - protein, 17 aa, Homo sapiens
  Native (PRAME_HUMAN)
NVLRLCCKKLKIFAMPM

SEQ ID NO: 346011 - protein, 18 aa, Homo sapiens
  Native (PRAME_HUMAN)
NVLRLCCKKLKIFAMPMQ

SEQ ID NO: 346012 - protein, 19 aa, Homo sapiens
  Native (PRAME_HUMAN)
NVLRLCCKKLKIFAMPMQD

SEQ ID NO: 346013 - protein, 20 aa, Homo sapiens
  Native (PRAME_HUMAN)
NVLRLCCKKLKIFAMPMQDI

SEQ ID NO: 346014 - protein, 21 aa, Homo sapiens
  Native (PRAME_HUMAN)
NVLRLCCKKLKIFAMPMQDIK

SEQ ID NO: 346015 - protein, 22 aa, Homo sapiens
  Native (PRAME_HUMAN)
NVLRLCCKKLKIFAMPMQDIKM

SEQ ID NO: 346016 - protein, 23 aa, Homo sapiens
  Native (PRAME_HUMAN)
NVLRLCCKKLKIFAMPMQDIKMI

SEQ ID NO: 346017 - protein, 24 aa, Homo sapiens
  Native (PRAME_HUMAN)
NVLRLCCKKLKIFAMPMQDIKMIL

SEQ ID NO: 346018 - protein, 25 aa, Homo sapiens
  Native (PRAME_HUMAN)
NVLRLCCKKLKIFAMPMQDIKMILK

SEQ ID NO: 346019 - protein, 24 aa, Homo sapiens
  Native (PRAME_HUMAN)
PCPHCGDRTFYDPEPILCPCFMPN

SEQ ID NO: 346020 - protein, 15 aa, Homo sapiens
  Native (PRAME_HUMAN)
PEAAQPMTKKRKVDG

SEQ ID NO: 346021 - protein, 17 aa, Homo sapiens
  Native (PRAME_HUMAN)
PEAAQPMTKKRKVDGLS

SEQ ID NO: 346022 - protein, 20 aa, Homo sapiens
  Native (PRAME_HUMAN)
PEAAQPMTKKRKVDGLSTEA

SEQ ID NO: 346023 - protein, 24 aa, Homo sapiens
  Native (PRAME_HUMAN)
PEAAQPMTKKRKVDGLSTEAEQPF

SEQ ID NO: 346024 - protein, 25 aa, Homo sapiens
  Native (PRAME_HUMAN)
PEAAQPMTKKRKVDGLSTEAEQPFI

SEQ ID NO: 346025 - protein, 15 aa, Homo sapiens
  Native (PRAME_HUMAN)
PEKEEQYIAQFTSQF

SEQ ID NO: 346026 - protein, 16 aa, Homo sapiens
  Native (PRAME_HUMAN)
PEKEEQYIAQFTSQFL

SEQ ID NO: 346027 - protein, 17 aa, Homo sapiens
  Native (PRAME_HUMAN)
PEKEEQYIAQFTSQFLS

SEQ ID NO: 346028 - protein, 18 aa, Homo sapiens
  Native (PRAME_HUMAN)
PEKEEQYIAQFTSQFLSL

SEQ ID NO: 346029 - protein, 19 aa, Homo sapiens
  Native (PRAME_HUMAN)
PEKEEQYIAQFTSQFLSLQ

SEQ ID NO: 346030 - protein, 20 aa, Homo sapiens
  Native (PRAME_HUMAN)
PEKEEQYIAQFTSQFLSLQC

SEQ ID NO: 346031 - protein, 21 aa, Homo sapiens
  Native (PRAME_HUMAN)
PEKEEQYIAQFTSQFLSLQCL

SEQ ID NO: 346032 - protein, 22 aa, Homo sapiens
  Native (PRAME_HUMAN)
PEKEEQYIAQFTSQFLSLQCLQ

SEQ ID NO: 346033 - protein, 23 aa, Homo sapiens
  Native (PRAME_HUMAN)
PEKEEQYIAQFTSQFLSLQCLQA

SEQ ID NO: 346034 - protein, 24 aa, Homo sapiens
  Native (PRAME_HUMAN)
PEKEEQYIAQFTSQFLSLQCLQAL

SEQ ID NO: 346035 - protein, 25 aa, Homo sapiens
  Native (PRAME_HUMAN)
PEKEEQYIAQFTSQFLSLQCLQALY

SEQ ID NO: 346036 - protein, 15 aa, Homo sapiens
  Native (PRAME_HUMAN)
PEPEAAQPMTKKRKV

SEQ ID NO: 346037 - protein, 20 aa, Homo sapiens
  Native (PRAME_HUMAN)
PEPEAAQPMTKKRKVDGLST

SEQ ID NO: 346038 - protein, 14 aa, Homo sapiens
  Native (PRAME_HUMAN)
PEPLQALLERASAT

SEQ ID NO: 346039 - protein, 15 aa, Homo sapiens
  Native (PRAME_HUMAN)
PEPLQALLERASATL

SEQ ID NO: 346040 - protein, 16 aa, Homo sapiens
  Native (PRAME_HUMAN)
PEPLQALLERASATLQ

SEQ ID NO: 346041 - protein, 17 aa, Homo sapiens
  Native (PRAME_HUMAN)
PEPLQALLERASATLQD

SEQ ID NO: 346042 - protein, 18 aa, Homo sapiens
  Native (PRAME_HUMAN)
PEPLQALLERASATLQDL

SEQ ID NO: 346043 - protein, 19 aa, Homo sapiens
  Native (PRAME_HUMAN)
PEPLQALLERASATLQDLV

SEQ ID NO: 346044 - protein, 20 aa, Homo sapiens
  Native (PRAME_HUMAN)
PEPLQALLERASATLQDLVF

SEQ ID NO: 346045 - protein, 21 aa, Homo sapiens
  Native (PRAME_HUMAN)
PEPLQALLERASATLQDLVFD

SEQ ID NO: 346046 - protein, 22 aa, Homo sapiens
  Native (PRAME_HUMAN)
PEPLQALLERASATLQDLVFDE

SEQ ID NO: 346047 - protein, 23 aa, Homo sapiens
  Native (PRAME_HUMAN)
PEPLQALLERASATLQDLVFDEC

SEQ ID NO: 346048 - protein, 24 aa, Homo sapiens
  Native (PRAME_HUMAN)
PEPLQALLERASATLQDLVFDECG

SEQ ID NO: 346049 - protein, 25 aa, Homo sapiens
  Native (PRAME_HUMAN)
PEPLQALLERASATLQDLVFDECGI

SEQ ID NO: 346050 - protein, 13 aa, Homo sapiens
  Native (PRAME_HUMAN)
PFIPVEVLVDLFL

SEQ ID NO: 346051 - protein, 14 aa, Homo sapiens
  Native (PRAME_HUMAN)
PFIPVEVLVDLFLK

SEQ ID NO: 346052 - protein, 15 aa, Homo sapiens
  Native (PRAME_HUMAN)
PFIPVEVLVDLFLKE

SEQ ID NO: 346053 - protein, 16 aa, Homo sapiens
  Native (PRAME_HUMAN)
PFIPVEVLVDLFLKEG

SEQ ID NO: 346054 - protein, 17 aa, Homo sapiens
  Native (PRAME_HUMAN)
PFIPVEVLVDLFLKEGA

SEQ ID NO: 346055 - protein, 18 aa, Homo sapiens
  Native (PRAME_HUMAN)
PFIPVEVLVDLFLKEGAC

SEQ ID NO: 346056 - protein, 19 aa, Homo sapiens
  Native (PRAME_HUMAN)
PFIPVEVLVDLFLKEGACD

SEQ ID NO: 346057 - protein, 20 aa, Homo sapiens
  Native (PRAME_HUMAN)
PFIPVEVLVDLFLKEGACDE

SEQ ID NO: 346058 - protein, 21 aa, Homo sapiens
  Native (PRAME_HUMAN)
PFIPVEVLVDLFLKEGACDEL

SEQ ID NO: 346059 - protein, 22 aa, Homo sapiens
  Native (PRAME_HUMAN)
PFIPVEVLVDLFLKEGACDELF

SEQ ID NO: 346060 - protein, 23 aa, Homo sapiens
  Native (PRAME_HUMAN)
PFIPVEVLVDLFLKEGACDELFS

SEQ ID NO: 346061 - protein, 24 aa, Homo sapiens
  Native (PRAME_HUMAN)
PFIPVEVLVDLFLKEGACDELFSY

SEQ ID NO: 346062 - protein, 25 aa, Homo sapiens
  Native (PRAME_HUMAN)
PFIPVEVLVDLFLKEGACDELFSYL

SEQ ID NO: 346063 - protein, 13 aa, Homo sapiens
  Native (PRAME_HUMAN)
PFTCLPLGVLMKG

SEQ ID NO: 346064 - protein, 14 aa, Homo sapiens
  Native (PRAME_HUMAN)
PFTCLPLGVLMKGQ

SEQ ID NO: 346065 - protein, 15 aa, Homo sapiens
  Native (PRAME_HUMAN)
PFTCLPLGVLMKGQH

SEQ ID NO: 346066 - protein, 16 aa, Homo sapiens
  Native (PRAME_HUMAN)
PFTCLPLGVLMKGQHL

SEQ ID NO: 346067 - protein, 17 aa, Homo sapiens
  Native (PRAME_HUMAN)
PFTCLPLGVLMKGQHLH

SEQ ID NO: 346068 - protein, 18 aa, Homo sapiens
  Native (PRAME_HUMAN)
PFTCLPLGVLMKGQHLHL

SEQ ID NO: 346069 - protein, 19 aa, Homo sapiens
  Native (PRAME_HUMAN)
PFTCLPLGVLMKGQHLHLE

SEQ ID NO: 346070 - protein, 20 aa, Homo sapiens
  Native (PRAME_HUMAN)
PFTCLPLGVLMKGQHLHLET

SEQ ID NO: 346071 - protein, 21 aa, Homo sapiens
  Native (PRAME_HUMAN)
PFTCLPLGVLMKGQHLHLETF

SEQ ID NO: 346072 - protein, 22 aa, Homo sapiens
  Native (PRAME_HUMAN)
PFTCLPLGVLMKGQHLHLETFK

SEQ ID NO: 346073 - protein, 23 aa, Homo sapiens
  Native (PRAME_HUMAN)
PFTCLPLGVLMKGQHLHLETFKA

SEQ ID NO: 346074 - protein, 24 aa, Homo sapiens
  Native (PRAME_HUMAN)
PFTCLPLGVLMKGQHLHLETFKAV

SEQ ID NO: 346075 - protein, 25 aa, Homo sapiens
  Native (PRAME_HUMAN)
PFTCLPLGVLMKGQHLHLETFKAVL

SEQ ID NO: 346076 - protein, 20 aa, Homo sapiens
  Native (PRAME_HUMAN)
PHCGDRTFYDPEPILCPCFM

SEQ ID NO: 346077 - protein, 22 aa, Homo sapiens
  Native (PRAME_HUMAN)
PHCGDRTFYDPEPILCPCFMPN

SEQ ID NO: 346078 - protein, 14 aa, Homo sapiens
  Native (PRAME_HUMAN)
PLESYEDIHGTLHL

SEQ ID NO: 346079 - protein, 15 aa, Homo sapiens
  Native (PRAME_HUMAN)
PLESYEDIHGTLHLE

SEQ ID NO: 346080 - protein, 16 aa, Homo sapiens
  Native (PRAME_HUMAN)
PLESYEDIHGTLHLER

SEQ ID NO: 346081 - protein, 17 aa, Homo sapiens
  Native (PRAME_HUMAN)
PLESYEDIHGTLHLERL

SEQ ID NO: 346082 - protein, 19 aa, Homo sapiens
  Native (PRAME_HUMAN)
PLESYEDIHGTLHLERLAY

SEQ ID NO: 346083 - protein, 20 aa, Homo sapiens
  Native (PRAME_HUMAN)
PLESYEDIHGTLHLERLAYL

SEQ ID NO: 346084 - protein, 21 aa, Homo sapiens
  Native (PRAME_HUMAN)
PLESYEDIHGTLHLERLAYLH

SEQ ID NO: 346085 - protein, 22 aa, Homo sapiens
  Native (PRAME_HUMAN)
PLESYEDIHGTLHLERLAYLHA

SEQ ID NO: 346086 - protein, 23 aa, Homo sapiens
  Native (PRAME_HUMAN)
PLESYEDIHGTLHLERLAYLHAR

SEQ ID NO: 346087 - protein, 24 aa, Homo sapiens
  Native (PRAME_HUMAN)
PLESYEDIHGTLHLERLAYLHARL

SEQ ID NO: 346088 - protein, 25 aa, Homo sapiens
  Native (PRAME_HUMAN)
PLESYEDIHGTLHLERLAYLHARLR

SEQ ID NO: 346089 - protein, 14 aa, Homo sapiens
  Native (PRAME_HUMAN)
PLETLSITNCRLSE

SEQ ID NO: 346090 - protein, 15 aa, Homo sapiens
  Native (PRAME_HUMAN)
PLETLSITNCRLSEG

SEQ ID NO: 346091 - protein, 16 aa, Homo sapiens
  Native (PRAME_HUMAN)
PLETLSITNCRLSEGD

SEQ ID NO: 346092 - protein, 17 aa, Homo sapiens
  Native (PRAME_HUMAN)
PLETLSITNCRLSEGDV

SEQ ID NO: 346093 - protein, 19 aa, Homo sapiens
  Native (PRAME_HUMAN)
PLETLSITNCRLSEGDVMH

SEQ ID NO: 346094 - protein, 20 aa, Homo sapiens
  Native (PRAME_HUMAN)
PLETLSITNCRLSEGDVMHL

SEQ ID NO: 346095 - protein, 21 aa, Homo sapiens
  Native (PRAME_HUMAN)
PLETLSITNCRLSEGDVMHLS

SEQ ID NO: 346096 - protein, 22 aa, Homo sapiens
  Native (PRAME_HUMAN)
PLETLSITNCRLSEGDVMHLSQ

SEQ ID NO: 346097 - protein, 23 aa, Homo sapiens
  Native (PRAME_HUMAN)
PLETLSITNCRLSEGDVMHLSQS

SEQ ID NO: 346098 - protein, 24 aa, Homo sapiens
  Native (PRAME_HUMAN)
PLETLSITNCRLSEGDVMHLSQSP

SEQ ID NO: 346099 - protein, 25 aa, Homo sapiens
  Native (PRAME_HUMAN)
PLETLSITNCRLSEGDVMHLSQSPS

SEQ ID NO: 346100 - protein, 14 aa, Homo sapiens
  Native (PRAME_HUMAN)
PLFMAAFDGRHSQT

SEQ ID NO: 346101 - protein, 15 aa, Homo sapiens
  Native (PRAME_HUMAN)
PLFMAAFDGRHSQTL

SEQ ID NO: 346102 - protein, 16 aa, Homo sapiens
  Native (PRAME_HUMAN)
PLFMAAFDGRHSQTLK

SEQ ID NO: 346103 - protein, 17 aa, Homo sapiens
  Native (PRAME_HUMAN)
PLFMAAFDGRHSQTLKA

SEQ ID NO: 346104 - protein, 18 aa, Homo sapiens
  Native (PRAME_HUMAN)
PLFMAAFDGRHSQTLKAM

SEQ ID NO: 346105 - protein, 19 aa, Homo sapiens
  Native (PRAME_HUMAN)
PLFMAAFDGRHSQTLKAMV

SEQ ID NO: 346106 - protein, 20 aa, Homo sapiens
  Native (PRAME_HUMAN)
PLFMAAFDGRHSQTLKAMVQ

SEQ ID NO: 346107 - protein, 21 aa, Homo sapiens
  Native (PRAME_HUMAN)
PLFMAAFDGRHSQTLKAMVQA

SEQ ID NO: 346108 - protein, 22 aa, Homo sapiens
  Native (PRAME_HUMAN)
PLFMAAFDGRHSQTLKAMVQAW

SEQ ID NO: 346109 - protein, 23 aa, Homo sapiens
  Native (PRAME_HUMAN)
PLFMAAFDGRHSQTLKAMVQAWP

SEQ ID NO: 346110 - protein, 24 aa, Homo sapiens
  Native (PRAME_HUMAN)
PLFMAAFDGRHSQTLKAMVQAWPF

SEQ ID NO: 346111 - protein, 25 aa, Homo sapiens
  Native (PRAME_HUMAN)
PLFMAAFDGRHSQTLKAMVQAWPFT

SEQ ID NO: 346112 - protein, 13 aa, Homo sapiens
  Native (PRAME_HUMAN)
PLGVLMKGQHLHL

SEQ ID NO: 346113 - protein, 14 aa, Homo sapiens
  Native (PRAME_HUMAN)
PLGVLMKGQHLHLE

SEQ ID NO: 346114 - protein, 15 aa, Homo sapiens
  Native (PRAME_HUMAN)
PLGVLMKGQHLHLET

SEQ ID NO: 346115 - protein, 16 aa, Homo sapiens
  Native (PRAME_HUMAN)
PLGVLMKGQHLHLETF

SEQ ID NO: 346116 - protein, 17 aa, Homo sapiens
  Native (PRAME_HUMAN)
PLGVLMKGQHLHLETFK

SEQ ID NO: 346117 - protein, 18 aa, Homo sapiens
  Native (PRAME_HUMAN)
PLGVLMKGQHLHLETFKA

SEQ ID NO: 346118 - protein, 19 aa, Homo sapiens
  Native (PRAME_HUMAN)
PLGVLMKGQHLHLETFKAV

SEQ ID NO: 346119 - protein, 20 aa, Homo sapiens
  Native (PRAME_HUMAN)
PLGVLMKGQHLHLETFKAVL

SEQ ID NO: 346120 - protein, 21 aa, Homo sapiens
  Native (PRAME_HUMAN)
PLGVLMKGQHLHLETFKAVLD

SEQ ID NO: 346121 - protein, 22 aa, Homo sapiens
  Native (PRAME_HUMAN)
PLGVLMKGQHLHLETFKAVLDG

SEQ ID NO: 346122 - protein, 23 aa, Homo sapiens
  Native (PRAME_HUMAN)
PLGVLMKGQHLHLETFKAVLDGL

SEQ ID NO: 346123 - protein, 24 aa, Homo sapiens
  Native (PRAME_HUMAN)
PLGVLMKGQHLHLETFKAVLDGLD

SEQ ID NO: 346124 - protein, 25 aa, Homo sapiens
  Native (PRAME_HUMAN)
PLGVLMKGQHLHLETFKAVLDGLDV

SEQ ID NO: 346125 - protein, 14 aa, Homo sapiens
  Native (PRAME_HUMAN)
PLQALLERASATLQ

SEQ ID NO: 346126 - protein, 15 aa, Homo sapiens
  Native (PRAME_HUMAN)
PLQALLERASATLQD

SEQ ID NO: 346127 - protein, 16 aa, Homo sapiens
  Native (PRAME_HUMAN)
PLQALLERASATLQDL

SEQ ID NO: 346128 - protein, 17 aa, Homo sapiens
  Native (PRAME_HUMAN)
PLQALLERASATLQDLV

SEQ ID NO: 346129 - protein, 18 aa, Homo sapiens
  Native (PRAME_HUMAN)
PLQALLERASATLQDLVF

SEQ ID NO: 346130 - protein, 19 aa, Homo sapiens
  Native (PRAME_HUMAN)
PLQALLERASATLQDLVFD

SEQ ID NO: 346131 - protein, 20 aa, Homo sapiens
  Native (PRAME_HUMAN)
PLQALLERASATLQDLVFDE

SEQ ID NO: 346132 - protein, 21 aa, Homo sapiens
  Native (PRAME_HUMAN)
PLQALLERASATLQDLVFDEC

SEQ ID NO: 346133 - protein, 22 aa, Homo sapiens
  Native (PRAME_HUMAN)
PLQALLERASATLQDLVFDECG

SEQ ID NO: 346134 - protein, 23 aa, Homo sapiens
  Native (PRAME_HUMAN)
PLQALLERASATLQDLVFDECGI

SEQ ID NO: 346135 - protein, 24 aa, Homo sapiens
  Native (PRAME_HUMAN)
PLQALLERASATLQDLVFDECGIT

SEQ ID NO: 346136 - protein, 25 aa, Homo sapiens
  Native (PRAME_HUMAN)
PLQALLERASATLQDLVFDECGITD

SEQ ID NO: 346137 - protein, 13 aa, Homo sapiens
  Native (PRAME_HUMAN)
PMQDIKMILKMVQ

SEQ ID NO: 346138 - protein, 14 aa, Homo sapiens
  Native (PRAME_HUMAN)
PMQDIKMILKMVQL

SEQ ID NO: 346139 - protein, 15 aa, Homo sapiens
  Native (PRAME_HUMAN)
PMQDIKMILKMVQLD

SEQ ID NO: 346140 - protein, 16 aa, Homo sapiens
  Native (PRAME_HUMAN)
PMQDIKMILKMVQLDS

SEQ ID NO: 346141 - protein, 17 aa, Homo sapiens
  Native (PRAME_HUMAN)
PMQDIKMILKMVQLDSI

SEQ ID NO: 346142 - protein, 18 aa, Homo sapiens
  Native (PRAME_HUMAN)
PMQDIKMILKMVQLDSIE

SEQ ID NO: 346143 - protein, 19 aa, Homo sapiens
  Native (PRAME_HUMAN)
PMQDIKMILKMVQLDSIED

SEQ ID NO: 346144 - protein, 20 aa, Homo sapiens
  Native (PRAME_HUMAN)
PMQDIKMILKMVQLDSIEDL

SEQ ID NO: 346145 - protein, 21 aa, Homo sapiens
  Native (PRAME_HUMAN)
PMQDIKMILKMVQLDSIEDLE

SEQ ID NO: 346146 - protein, 22 aa, Homo sapiens
  Native (PRAME_HUMAN)
PMQDIKMILKMVQLDSIEDLEV

SEQ ID NO: 346147 - protein, 23 aa, Homo sapiens
  Native (PRAME_HUMAN)
PMQDIKMILKMVQLDSIEDLEVT

SEQ ID NO: 346148 - protein, 24 aa, Homo sapiens
  Native (PRAME_HUMAN)
PMQDIKMILKMVQLDSIEDLEVTC

SEQ ID NO: 346149 - protein, 25 aa, Homo sapiens
  Native (PRAME_HUMAN)
PMQDIKMILKMVQLDSIEDLEVTCT

SEQ ID NO: 346150 - protein, 19 aa, Homo sapiens
  Native (PRAME_HUMAN)
PMTKKRKVDGLSTEAEQPF

SEQ ID NO: 346151 - protein, 20 aa, Homo sapiens
  Native (PRAME_HUMAN)
PMTKKRKVDGLSTEAEQPFI

SEQ ID NO: 346152 - protein, 21 aa, Homo sapiens
  Native (PRAME_HUMAN)
PMTKKRKVDGLSTEAEQPFIP

SEQ ID NO: 346153 - protein, 22 aa, Homo sapiens
  Native (PRAME_HUMAN)
PMTKKRKVDGLSTEAEQPFIPV

SEQ ID NO: 346154 - protein, 23 aa, Homo sapiens
  Native (PRAME_HUMAN)
PMTKKRKVDGLSTEAEQPFIPVE

SEQ ID NO: 346155 - protein, 24 aa, Homo sapiens
  Native (PRAME_HUMAN)
PMTKKRKVDGLSTEAEQPFIPVEV

SEQ ID NO: 346156 - protein, 25 aa, Homo sapiens
  Native (PRAME_HUMAN)
PMTKKRKVDGLSTEAEQPFIPVEVL

SEQ ID NO: 346157 - protein, 14 aa, Homo sapiens
  Native (PRAME_HUMAN)
PPLFMAAFDGRHSQ

SEQ ID NO: 346158 - protein, 15 aa, Homo sapiens
  Native (PRAME_HUMAN)
PPLFMAAFDGRHSQT

SEQ ID NO: 346159 - protein, 16 aa, Homo sapiens
  Native (PRAME_HUMAN)
PPLFMAAFDGRHSQTL

SEQ ID NO: 346160 - protein, 17 aa, Homo sapiens
  Native (PRAME_HUMAN)
PPLFMAAFDGRHSQTLK

SEQ ID NO: 346161 - protein, 18 aa, Homo sapiens
  Native (PRAME_HUMAN)
PPLFMAAFDGRHSQTLKA

SEQ ID NO: 346162 - protein, 19 aa, Homo sapiens
  Native (PRAME_HUMAN)
PPLFMAAFDGRHSQTLKAM

SEQ ID NO: 346163 - protein, 20 aa, Homo sapiens
  Native (PRAME_HUMAN)
PPLFMAAFDGRHSQTLKAMV

SEQ ID NO: 346164 - protein, 21 aa, Homo sapiens
  Native (PRAME_HUMAN)
PPLFMAAFDGRHSQTLKAMVQ

SEQ ID NO: 346165 - protein, 22 aa, Homo sapiens
  Native (PRAME_HUMAN)
PPLFMAAFDGRHSQTLKAMVQA

SEQ ID NO: 346166 - protein, 23 aa, Homo sapiens
  Native (PRAME_HUMAN)
PPLFMAAFDGRHSQTLKAMVQAW

SEQ ID NO: 346167 - protein, 24 aa, Homo sapiens
  Native (PRAME_HUMAN)
PPLFMAAFDGRHSQTLKAMVQAWP

SEQ ID NO: 346168 - protein, 25 aa, Homo sapiens
  Native (PRAME_HUMAN)
PPLFMAAFDGRHSQTLKAMVQAWPF

SEQ ID NO: 346169 - protein, 13 aa, Homo sapiens
  Native (PRAME_HUMAN)
PRELFPPLFMAAF

SEQ ID NO: 346170 - protein, 14 aa, Homo sapiens
  Native (PRAME_HUMAN)
PRELFPPLFMAAFD

SEQ ID NO: 346171 - protein, 15 aa, Homo sapiens
  Native (PRAME_HUMAN)
PRELFPPLFMAAFDG

SEQ ID NO: 346172 - protein, 16 aa, Homo sapiens
  Native (PRAME_HUMAN)
PRELFPPLFMAAFDGR

SEQ ID NO: 346173 - protein, 17 aa, Homo sapiens
  Native (PRAME_HUMAN)
PRELFPPLFMAAFDGRH

SEQ ID NO: 346174 - protein, 18 aa, Homo sapiens
  Native (PRAME_HUMAN)
PRELFPPLFMAAFDGRHS

SEQ ID NO: 346175 - protein, 19 aa, Homo sapiens
  Native (PRAME_HUMAN)
PRELFPPLFMAAFDGRHSQ

SEQ ID NO: 346176 - protein, 20 aa, Homo sapiens
  Native (PRAME_HUMAN)
PRELFPPLFMAAFDGRHSQT

SEQ ID NO: 346177 - protein, 21 aa, Homo sapiens
  Native (PRAME_HUMAN)
PRELFPPLFMAAFDGRHSQTL

SEQ ID NO: 346178 - protein, 22 aa, Homo sapiens
  Native (PRAME_HUMAN)
PRELFPPLFMAAFDGRHSQTLK

SEQ ID NO: 346179 - protein, 23 aa, Homo sapiens
  Native (PRAME_HUMAN)
PRELFPPLFMAAFDGRHSQTLKA

SEQ ID NO: 346180 - protein, 24 aa, Homo sapiens
  Native (PRAME_HUMAN)
PRELFPPLFMAAFDGRHSQTLKAM

SEQ ID NO: 346181 - protein, 25 aa, Homo sapiens
  Native (PRAME_HUMAN)
PRELFPPLFMAAFDGRHSQTLKAMV

SEQ ID NO: 346182 - protein, 13 aa, Homo sapiens
  Native (PRAME_HUMAN)
PRRLVELAGQSLL

SEQ ID NO: 346183 - protein, 14 aa, Homo sapiens
  Native (PRAME_HUMAN)
PRRLVELAGQSLLK

SEQ ID NO: 346184 - protein, 15 aa, Homo sapiens
  Native (PRAME_HUMAN)
PRRLVELAGQSLLKD

SEQ ID NO: 346185 - protein, 16 aa, Homo sapiens
  Native (PRAME_HUMAN)
PRRLVELAGQSLLKDE

SEQ ID NO: 346186 - protein, 17 aa, Homo sapiens
  Native (PRAME_HUMAN)
PRRLVELAGQSLLKDEA

SEQ ID NO: 346187 - protein, 18 aa, Homo sapiens
  Native (PRAME_HUMAN)
PRRLVELAGQSLLKDEAL

SEQ ID NO: 346188 - protein, 19 aa, Homo sapiens
  Native (PRAME_HUMAN)
PRRLVELAGQSLLKDEALA

SEQ ID NO: 346189 - protein, 20 aa, Homo sapiens
  Native (PRAME_HUMAN)
PRRLVELAGQSLLKDEALAI

SEQ ID NO: 346190 - protein, 21 aa, Homo sapiens
  Native (PRAME_HUMAN)
PRRLVELAGQSLLKDEALAIA

SEQ ID NO: 346191 - protein, 22 aa, Homo sapiens
  Native (PRAME_HUMAN)
PRRLVELAGQSLLKDEALAIAA

SEQ ID NO: 346192 - protein, 23 aa, Homo sapiens
  Native (PRAME_HUMAN)
PRRLVELAGQSLLKDEALAIAAL

SEQ ID NO: 346193 - protein, 24 aa, Homo sapiens
  Native (PRAME_HUMAN)
PRRLVELAGQSLLKDEALAIAALE

SEQ ID NO: 346194 - protein, 25 aa, Homo sapiens
  Native (PRAME_HUMAN)
PRRLVELAGQSLLKDEALAIAALEL

SEQ ID NO: 346195 - protein, 13 aa, Homo sapiens
  Native (PRAME_HUMAN)
PRRWKLQVLDLRK

SEQ ID NO: 346196 - protein, 14 aa, Homo sapiens
  Native (PRAME_HUMAN)
PRRWKLQVLDLRKN

SEQ ID NO: 346197 - protein, 15 aa, Homo sapiens
  Native (PRAME_HUMAN)
PRRWKLQVLDLRKNS

SEQ ID NO: 346198 - protein, 16 aa, Homo sapiens
  Native (PRAME_HUMAN)
PRRWKLQVLDLRKNSH

SEQ ID NO: 346199 - protein, 17 aa, Homo sapiens
  Native (PRAME_HUMAN)
PRRWKLQVLDLRKNSHQ

SEQ ID NO: 346200 - protein, 18 aa, Homo sapiens
  Native (PRAME_HUMAN)
PRRWKLQVLDLRKNSHQD

SEQ ID NO: 346201 - protein, 19 aa, Homo sapiens
  Native (PRAME_HUMAN)
PRRWKLQVLDLRKNSHQDF

SEQ ID NO: 346202 - protein, 20 aa, Homo sapiens
  Native (PRAME_HUMAN)
PRRWKLQVLDLRKNSHQDFW

SEQ ID NO: 346203 - protein, 21 aa, Homo sapiens
  Native (PRAME_HUMAN)
PRRWKLQVLDLRKNSHQDFWT

SEQ ID NO: 346204 - protein, 22 aa, Homo sapiens
  Native (PRAME_HUMAN)
PRRWKLQVLDLRKNSHQDFWTV

SEQ ID NO: 346205 - protein, 23 aa, Homo sapiens
  Native (PRAME_HUMAN)
PRRWKLQVLDLRKNSHQDFWTVW

SEQ ID NO: 346206 - protein, 24 aa, Homo sapiens
  Native (PRAME_HUMAN)
PRRWKLQVLDLRKNSHQDFWTVWS

SEQ ID NO: 346207 - protein, 25 aa, Homo sapiens
  Native (PRAME_HUMAN)
PRRWKLQVLDLRKNSHQDFWTVWSG

SEQ ID NO: 346208 - protein, 15 aa, Homo sapiens
  Native (PRAME_HUMAN)
PSLSHCSQLTTLSFY

SEQ ID NO: 346209 - protein, 16 aa, Homo sapiens
  Native (PRAME_HUMAN)
PSLSHCSQLTTLSFYG

SEQ ID NO: 346210 - protein, 17 aa, Homo sapiens
  Native (PRAME_HUMAN)
PSLSHCSQLTTLSFYGN

SEQ ID NO: 346211 - protein, 19 aa, Homo sapiens
  Native (PRAME_HUMAN)
PSLSHCSQLTTLSFYGNSI

SEQ ID NO: 346212 - protein, 20 aa, Homo sapiens
  Native (PRAME_HUMAN)
PSLSHCSQLTTLSFYGNSIS

SEQ ID NO: 346213 - protein, 21 aa, Homo sapiens
  Native (PRAME_HUMAN)
PSLSHCSQLTTLSFYGNSISI

SEQ ID NO: 346214 - protein, 22 aa, Homo sapiens
  Native (PRAME_HUMAN)
PSLSHCSQLTTLSFYGNSISIS

SEQ ID NO: 346215 - protein, 23 aa, Homo sapiens
  Native (PRAME_HUMAN)
PSLSHCSQLTTLSFYGNSISISA

SEQ ID NO: 346216 - protein, 24 aa, Homo sapiens
  Native (PRAME_HUMAN)
PSLSHCSQLTTLSFYGNSISISAL

SEQ ID NO: 346217 - protein, 25 aa, Homo sapiens
  Native (PRAME_HUMAN)
PSLSHCSQLTTLSFYGNSISISALQ

SEQ ID NO: 346218 - protein, 13 aa, Homo sapiens
  Native (PRAME_HUMAN)
PSMVWLSANPCPH

SEQ ID NO: 346219 - protein, 14 aa, Homo sapiens
  Native (PRAME_HUMAN)
PSMVWLSANPCPHC

SEQ ID NO: 346220 - protein, 15 aa, Homo sapiens
  Native (PRAME_HUMAN)
PSMVWLSANPCPHCG

SEQ ID NO: 346221 - protein, 16 aa, Homo sapiens
  Native (PRAME_HUMAN)
PSMVWLSANPCPHCGD

SEQ ID NO: 346222 - protein, 17 aa, Homo sapiens
  Native (PRAME_HUMAN)
PSMVWLSANPCPHCGDR

SEQ ID NO: 346223 - protein, 19 aa, Homo sapiens
  Native (PRAME_HUMAN)
PSMVWLSANPCPHCGDRTF

SEQ ID NO: 346224 - protein, 20 aa, Homo sapiens
  Native (PRAME_HUMAN)
PSMVWLSANPCPHCGDRTFY

SEQ ID NO: 346225 - protein, 21 aa, Homo sapiens
  Native (PRAME_HUMAN)
PSMVWLSANPCPHCGDRTFYD

SEQ ID NO: 346226 - protein, 22 aa, Homo sapiens
  Native (PRAME_HUMAN)
PSMVWLSANPCPHCGDRTFYDP

SEQ ID NO: 346227 - protein, 23 aa, Homo sapiens
  Native (PRAME_HUMAN)
PSMVWLSANPCPHCGDRTFYDPE

SEQ ID NO: 346228 - protein, 24 aa, Homo sapiens
  Native (PRAME_HUMAN)
PSMVWLSANPCPHCGDRTFYDPEP

SEQ ID NO: 346229 - protein, 25 aa, Homo sapiens
  Native (PRAME_HUMAN)
PSMVWLSANPCPHCGDRTFYDPEPI

SEQ ID NO: 346230 - protein, 14 aa, Homo sapiens
  Native (PRAME_HUMAN)
PSVSQLSVLSLSGV

SEQ ID NO: 346231 - protein, 15 aa, Homo sapiens
  Native (PRAME_HUMAN)
PSVSQLSVLSLSGVM

SEQ ID NO: 346232 - protein, 16 aa, Homo sapiens
  Native (PRAME_HUMAN)
PSVSQLSVLSLSGVML

SEQ ID NO: 346233 - protein, 17 aa, Homo sapiens
  Native (PRAME_HUMAN)
PSVSQLSVLSLSGVMLT

SEQ ID NO: 346234 - protein, 18 aa, Homo sapiens
  Native (PRAME_HUMAN)
PSVSQLSVLSLSGVMLTD

SEQ ID NO: 346235 - protein, 19 aa, Homo sapiens
  Native (PRAME_HUMAN)
PSVSQLSVLSLSGVMLTDV

SEQ ID NO: 346236 - protein, 20 aa, Homo sapiens
  Native (PRAME_HUMAN)
PSVSQLSVLSLSGVMLTDVS

SEQ ID NO: 346237 - protein, 21 aa, Homo sapiens
  Native (PRAME_HUMAN)
PSVSQLSVLSLSGVMLTDVSP

SEQ ID NO: 346238 - protein, 22 aa, Homo sapiens
  Native (PRAME_HUMAN)
PSVSQLSVLSLSGVMLTDVSPE

SEQ ID NO: 346239 - protein, 23 aa, Homo sapiens
  Native (PRAME_HUMAN)
PSVSQLSVLSLSGVMLTDVSPEP

SEQ ID NO: 346240 - protein, 24 aa, Homo sapiens
  Native (PRAME_HUMAN)
PSVSQLSVLSLSGVMLTDVSPEPL

SEQ ID NO: 346241 - protein, 25 aa, Homo sapiens
  Native (PRAME_HUMAN)
PSVSQLSVLSLSGVMLTDVSPEPLQ

SEQ ID NO: 346242 - protein, 14 aa, Homo sapiens
  Native (PRAME_HUMAN)
PTLAKFSPYLGQMI

SEQ ID NO: 346243 - protein, 15 aa, Homo sapiens
  Native (PRAME_HUMAN)
PTLAKFSPYLGQMIN

SEQ ID NO: 346244 - protein, 16 aa, Homo sapiens
  Native (PRAME_HUMAN)
PTLAKFSPYLGQMINL

SEQ ID NO: 346245 - protein, 17 aa, Homo sapiens
  Native (PRAME_HUMAN)
PTLAKFSPYLGQMINLR

SEQ ID NO: 346246 - protein, 18 aa, Homo sapiens
  Native (PRAME_HUMAN)
PTLAKFSPYLGQMINLRR

SEQ ID NO: 346247 - protein, 19 aa, Homo sapiens
  Native (PRAME_HUMAN)
PTLAKFSPYLGQMINLRRL

SEQ ID NO: 346248 - protein, 20 aa, Homo sapiens
  Native (PRAME_HUMAN)
PTLAKFSPYLGQMINLRRLL

SEQ ID NO: 346249 - protein, 21 aa, Homo sapiens
  Native (PRAME_HUMAN)
PTLAKFSPYLGQMINLRRLLL

SEQ ID NO: 346250 - protein, 22 aa, Homo sapiens
  Native (PRAME_HUMAN)
PTLAKFSPYLGQMINLRRLLLS

SEQ ID NO: 346251 - protein, 23 aa, Homo sapiens
  Native (PRAME_HUMAN)
PTLAKFSPYLGQMINLRRLLLSH

SEQ ID NO: 346252 - protein, 24 aa, Homo sapiens
  Native (PRAME_HUMAN)
PTLAKFSPYLGQMINLRRLLLSHI

SEQ ID NO: 346253 - protein, 25 aa, Homo sapiens
  Native (PRAME_HUMAN)
PTLAKFSPYLGQMINLRRLLLSHIH

SEQ ID NO: 346254 - protein, 13 aa, Homo sapiens
  Native (PRAME_HUMAN)
PVEVLVDLFLKEG

SEQ ID NO: 346255 - protein, 14 aa, Homo sapiens
  Native (PRAME_HUMAN)
PVEVLVDLFLKEGA

SEQ ID NO: 346256 - protein, 15 aa, Homo sapiens
  Native (PRAME_HUMAN)
PVEVLVDLFLKEGAC

SEQ ID NO: 346257 - protein, 16 aa, Homo sapiens
  Native (PRAME_HUMAN)
PVEVLVDLFLKEGACD

SEQ ID NO: 346258 - protein, 17 aa, Homo sapiens
  Native (PRAME_HUMAN)
PVEVLVDLFLKEGACDE

SEQ ID NO: 346259 - protein, 18 aa, Homo sapiens
  Native (PRAME_HUMAN)
PVEVLVDLFLKEGACDEL

SEQ ID NO: 346260 - protein, 19 aa, Homo sapiens
  Native (PRAME_HUMAN)
PVEVLVDLFLKEGACDELF

SEQ ID NO: 346261 - protein, 20 aa, Homo sapiens
  Native (PRAME_HUMAN)
PVEVLVDLFLKEGACDELFS

SEQ ID NO: 346262 - protein, 21 aa, Homo sapiens
  Native (PRAME_HUMAN)
PVEVLVDLFLKEGACDELFSY

SEQ ID NO: 346263 - protein, 22 aa, Homo sapiens
  Native (PRAME_HUMAN)
PVEVLVDLFLKEGACDELFSYL

SEQ ID NO: 346264 - protein, 23 aa, Homo sapiens
  Native (PRAME_HUMAN)
PVEVLVDLFLKEGACDELFSYLI

SEQ ID NO: 346265 - protein, 24 aa, Homo sapiens
  Native (PRAME_HUMAN)
PVEVLVDLFLKEGACDELFSYLIE

SEQ ID NO: 346266 - protein, 25 aa, Homo sapiens
  Native (PRAME_HUMAN)
PVEVLVDLFLKEGACDELFSYLIEK

SEQ ID NO: 346267 - protein, 14 aa, Homo sapiens
  Native (PRAME_HUMAN)
PVPLESYEDIHGTL

SEQ ID NO: 346268 - protein, 15 aa, Homo sapiens
  Native (PRAME_HUMAN)
PVPLESYEDIHGTLH

SEQ ID NO: 346269 - protein, 16 aa, Homo sapiens
  Native (PRAME_HUMAN)
PVPLESYEDIHGTLHL

SEQ ID NO: 346270 - protein, 17 aa, Homo sapiens
  Native (PRAME_HUMAN)
PVPLESYEDIHGTLHLE

SEQ ID NO: 346271 - protein, 18 aa, Homo sapiens
  Native (PRAME_HUMAN)
PVPLESYEDIHGTLHLER

SEQ ID NO: 346272 - protein, 19 aa, Homo sapiens
  Native (PRAME_HUMAN)
PVPLESYEDIHGTLHLERL

SEQ ID NO: 346273 - protein, 20 aa, Homo sapiens
  Native (PRAME_HUMAN)
PVPLESYEDIHGTLHLERLA

SEQ ID NO: 346274 - protein, 21 aa, Homo sapiens
  Native (PRAME_HUMAN)
PVPLESYEDIHGTLHLERLAY

SEQ ID NO: 346275 - protein, 22 aa, Homo sapiens
  Native (PRAME_HUMAN)
PVPLESYEDIHGTLHLERLAYL

SEQ ID NO: 346276 - protein, 23 aa, Homo sapiens
  Native (PRAME_HUMAN)
PVPLESYEDIHGTLHLERLAYLH

SEQ ID NO: 346277 - protein, 24 aa, Homo sapiens
  Native (PRAME_HUMAN)
PVPLESYEDIHGTLHLERLAYLHA

SEQ ID NO: 346278 - protein, 25 aa, Homo sapiens
  Native (PRAME_HUMAN)
PVPLESYEDIHGTLHLERLAYLHAR

SEQ ID NO: 346279 - protein, 13 aa, Homo sapiens
  Native (PRAME_HUMAN)
PYLGQMINLRRLL

SEQ ID NO: 346280 - protein, 14 aa, Homo sapiens
  Native (PRAME_HUMAN)
PYLGQMINLRRLLL

SEQ ID NO: 346281 - protein, 15 aa, Homo sapiens
  Native (PRAME_HUMAN)
PYLGQMINLRRLLLS

SEQ ID NO: 346282 - protein, 16 aa, Homo sapiens
  Native (PRAME_HUMAN)
PYLGQMINLRRLLLSH

SEQ ID NO: 346283 - protein, 17 aa, Homo sapiens
  Native (PRAME_HUMAN)
PYLGQMINLRRLLLSHI

SEQ ID NO: 346284 - protein, 18 aa, Homo sapiens
  Native (PRAME_HUMAN)
PYLGQMINLRRLLLSHIH

SEQ ID NO: 346285 - protein, 19 aa, Homo sapiens
  Native (PRAME_HUMAN)
PYLGQMINLRRLLLSHIHA

SEQ ID NO: 346286 - protein, 20 aa, Homo sapiens
  Native (PRAME_HUMAN)
PYLGQMINLRRLLLSHIHAS

SEQ ID NO: 346287 - protein, 21 aa, Homo sapiens
  Native (PRAME_HUMAN)
PYLGQMINLRRLLLSHIHASS

SEQ ID NO: 346288 - protein, 22 aa, Homo sapiens
  Native (PRAME_HUMAN)
PYLGQMINLRRLLLSHIHASSY

SEQ ID NO: 346289 - protein, 23 aa, Homo sapiens
  Native (PRAME_HUMAN)
PYLGQMINLRRLLLSHIHASSYI

SEQ ID NO: 346290 - protein, 24 aa, Homo sapiens
  Native (PRAME_HUMAN)
PYLGQMINLRRLLLSHIHASSYIS

SEQ ID NO: 346291 - protein, 25 aa, Homo sapiens
  Native (PRAME_HUMAN)
PYLGQMINLRRLLLSHIHASSYISP

SEQ ID NO: 346292 - protein, 14 aa, Homo sapiens
  Native (PRAME_HUMAN)
QALLERASATLQDL

SEQ ID NO: 346293 - protein, 15 aa, Homo sapiens
  Native (PRAME_HUMAN)
QALLERASATLQDLV

SEQ ID NO: 346294 - protein, 16 aa, Homo sapiens
  Native (PRAME_HUMAN)
QALLERASATLQDLVF

SEQ ID NO: 346295 - protein, 17 aa, Homo sapiens
  Native (PRAME_HUMAN)
QALLERASATLQDLVFD

SEQ ID NO: 346296 - protein, 18 aa, Homo sapiens
  Native (PRAME_HUMAN)
QALLERASATLQDLVFDE

SEQ ID NO: 346297 - protein, 19 aa, Homo sapiens
  Native (PRAME_HUMAN)
QALLERASATLQDLVFDEC

SEQ ID NO: 346298 - protein, 20 aa, Homo sapiens
  Native (PRAME_HUMAN)
QALLERASATLQDLVFDECG

SEQ ID NO: 346299 - protein, 21 aa, Homo sapiens
  Native (PRAME_HUMAN)
QALLERASATLQDLVFDECGI

SEQ ID NO: 346300 - protein, 22 aa, Homo sapiens
  Native (PRAME_HUMAN)
QALLERASATLQDLVFDECGIT

SEQ ID NO: 346301 - protein, 23 aa, Homo sapiens
  Native (PRAME_HUMAN)
QALLERASATLQDLVFDECGITD

SEQ ID NO: 346302 - protein, 24 aa, Homo sapiens
  Native (PRAME_HUMAN)
QALLERASATLQDLVFDECGITDD

SEQ ID NO: 346303 - protein, 25 aa, Homo sapiens
  Native (PRAME_HUMAN)
QALLERASATLQDLVFDECGITDDQ

SEQ ID NO: 346304 - protein, 13 aa, Homo sapiens
  Native (PRAME_HUMAN)
QALYVDSLFFLRG

SEQ ID NO: 346305 - protein, 14 aa, Homo sapiens
  Native (PRAME_HUMAN)
QALYVDSLFFLRGR

SEQ ID NO: 346306 - protein, 15 aa, Homo sapiens
  Native (PRAME_HUMAN)
QALYVDSLFFLRGRL

SEQ ID NO: 346307 - protein, 16 aa, Homo sapiens
  Native (PRAME_HUMAN)
QALYVDSLFFLRGRLD

SEQ ID NO: 346308 - protein, 18 aa, Homo sapiens
  Native (PRAME_HUMAN)
QALYVDSLFFLRGRLDQL

SEQ ID NO: 346309 - protein, 19 aa, Homo sapiens
  Native (PRAME_HUMAN)
QALYVDSLFFLRGRLDQLL

SEQ ID NO: 346310 - protein, 20 aa, Homo sapiens
  Native (PRAME_HUMAN)
QALYVDSLFFLRGRLDQLLR

SEQ ID NO: 346311 - protein, 21 aa, Homo sapiens
  Native (PRAME_HUMAN)
QALYVDSLFFLRGRLDQLLRH

SEQ ID NO: 346312 - protein, 22 aa, Homo sapiens
  Native (PRAME_HUMAN)
QALYVDSLFFLRGRLDQLLRHV

SEQ ID NO: 346313 - protein, 23 aa, Homo sapiens
  Native (PRAME_HUMAN)
QALYVDSLFFLRGRLDQLLRHVM

SEQ ID NO: 346314 - protein, 24 aa, Homo sapiens
  Native (PRAME_HUMAN)
QALYVDSLFFLRGRLDQLLRHVMN

SEQ ID NO: 346315 - protein, 25 aa, Homo sapiens
  Native (PRAME_HUMAN)
QALYVDSLFFLRGRLDQLLRHVMNP

SEQ ID NO: 346316 - protein, 13 aa, Homo sapiens
  Native (PRAME_HUMAN)
QAWPFTCLPLGVL

SEQ ID NO: 346317 - protein, 14 aa, Homo sapiens
  Native (PRAME_HUMAN)
QAWPFTCLPLGVLM

SEQ ID NO: 346318 - protein, 15 aa, Homo sapiens
  Native (PRAME_HUMAN)
QAWPFTCLPLGVLMK

SEQ ID NO: 346319 - protein, 16 aa, Homo sapiens
  Native (PRAME_HUMAN)
QAWPFTCLPLGVLMKG

SEQ ID NO: 346320 - protein, 17 aa, Homo sapiens
  Native (PRAME_HUMAN)
QAWPFTCLPLGVLMKGQ

SEQ ID NO: 346321 - protein, 18 aa, Homo sapiens
  Native (PRAME_HUMAN)
QAWPFTCLPLGVLMKGQH

SEQ ID NO: 346322 - protein, 19 aa, Homo sapiens
  Native (PRAME_HUMAN)
QAWPFTCLPLGVLMKGQHL

SEQ ID NO: 346323 - protein, 20 aa, Homo sapiens
  Native (PRAME_HUMAN)
QAWPFTCLPLGVLMKGQHLH

SEQ ID NO: 346324 - protein, 21 aa, Homo sapiens
  Native (PRAME_HUMAN)
QAWPFTCLPLGVLMKGQHLHL

SEQ ID NO: 346325 - protein, 22 aa, Homo sapiens
  Native (PRAME_HUMAN)
QAWPFTCLPLGVLMKGQHLHLE

SEQ ID NO: 346326 - protein, 23 aa, Homo sapiens
  Native (PRAME_HUMAN)
QAWPFTCLPLGVLMKGQHLHLET

SEQ ID NO: 346327 - protein, 24 aa, Homo sapiens
  Native (PRAME_HUMAN)
QAWPFTCLPLGVLMKGQHLHLETF

SEQ ID NO: 346328 - protein, 25 aa, Homo sapiens
  Native (PRAME_HUMAN)
QAWPFTCLPLGVLMKGQHLHLETFK

SEQ ID NO: 346329 - protein, 13 aa, Homo sapiens
  Native (PRAME_HUMAN)
QCLQALYVDSLFF

SEQ ID NO: 346330 - protein, 14 aa, Homo sapiens
  Native (PRAME_HUMAN)
QCLQALYVDSLFFL

SEQ ID NO: 346331 - protein, 15 aa, Homo sapiens
  Native (PRAME_HUMAN)
QCLQALYVDSLFFLR

SEQ ID NO: 346332 - protein, 16 aa, Homo sapiens
  Native (PRAME_HUMAN)
QCLQALYVDSLFFLRG

SEQ ID NO: 346333 - protein, 17 aa, Homo sapiens
  Native (PRAME_HUMAN)
QCLQALYVDSLFFLRGR

SEQ ID NO: 346334 - protein, 18 aa, Homo sapiens
  Native (PRAME_HUMAN)
QCLQALYVDSLFFLRGRL

SEQ ID NO: 346335 - protein, 19 aa, Homo sapiens
  Native (PRAME_HUMAN)
QCLQALYVDSLFFLRGRLD

SEQ ID NO: 346336 - protein, 20 aa, Homo sapiens
  Native (PRAME_HUMAN)
QCLQALYVDSLFFLRGRLDQ

SEQ ID NO: 346337 - protein, 21 aa, Homo sapiens
  Native (PRAME_HUMAN)
QCLQALYVDSLFFLRGRLDQL

SEQ ID NO: 346338 - protein, 22 aa, Homo sapiens
  Native (PRAME_HUMAN)
QCLQALYVDSLFFLRGRLDQLL

SEQ ID NO: 346339 - protein, 23 aa, Homo sapiens
  Native (PRAME_HUMAN)
QCLQALYVDSLFFLRGRLDQLLR

SEQ ID NO: 346340 - protein, 24 aa, Homo sapiens
  Native (PRAME_HUMAN)
QCLQALYVDSLFFLRGRLDQLLRH

SEQ ID NO: 346341 - protein, 25 aa, Homo sapiens
  Native (PRAME_HUMAN)
QCLQALYVDSLFFLRGRLDQLLRHV

SEQ ID NO: 346342 - protein, 13 aa, Homo sapiens
  Native (PRAME_HUMAN)
QDFWTVWSGNRAS

SEQ ID NO: 346343 - protein, 14 aa, Homo sapiens
  Native (PRAME_HUMAN)
QDFWTVWSGNRASL

SEQ ID NO: 346344 - protein, 15 aa, Homo sapiens
  Native (PRAME_HUMAN)
QDFWTVWSGNRASLY

SEQ ID NO: 346345 - protein, 16 aa, Homo sapiens
  Native (PRAME_HUMAN)
QDFWTVWSGNRASLYS

SEQ ID NO: 346346 - protein, 17 aa, Homo sapiens
  Native (PRAME_HUMAN)
QDFWTVWSGNRASLYSF

SEQ ID NO: 346347 - protein, 18 aa, Homo sapiens
  Native (PRAME_HUMAN)
QDFWTVWSGNRASLYSFP

SEQ ID NO: 346348 - protein, 19 aa, Homo sapiens
  Native (PRAME_HUMAN)
QDFWTVWSGNRASLYSFPE

SEQ ID NO: 346349 - protein, 20 aa, Homo sapiens
  Native (PRAME_HUMAN)
QDFWTVWSGNRASLYSFPEP

SEQ ID NO: 346350 - protein, 21 aa, Homo sapiens
  Native (PRAME_HUMAN)
QDFWTVWSGNRASLYSFPEPE

SEQ ID NO: 346351 - protein, 22 aa, Homo sapiens
  Native (PRAME_HUMAN)
QDFWTVWSGNRASLYSFPEPEA

SEQ ID NO: 346352 - protein, 23 aa, Homo sapiens
  Native (PRAME_HUMAN)
QDFWTVWSGNRASLYSFPEPEAA

SEQ ID NO: 346353 - protein, 24 aa, Homo sapiens
  Native (PRAME_HUMAN)
QDFWTVWSGNRASLYSFPEPEAAQ

SEQ ID NO: 346354 - protein, 25 aa, Homo sapiens
  Native (PRAME_HUMAN)
QDFWTVWSGNRASLYSFPEPEAAQP

SEQ ID NO: 346355 - protein, 13 aa, Homo sapiens
  Native (PRAME_HUMAN)
QDIKMILKMVQLD

SEQ ID NO: 346356 - protein, 14 aa, Homo sapiens
  Native (PRAME_HUMAN)
QDIKMILKMVQLDS

SEQ ID NO: 346357 - protein, 16 aa, Homo sapiens
  Native (PRAME_HUMAN)
QDIKMILKMVQLDSIE

SEQ ID NO: 346358 - protein, 17 aa, Homo sapiens
  Native (PRAME_HUMAN)
QDIKMILKMVQLDSIED

SEQ ID NO: 346359 - protein, 18 aa, Homo sapiens
  Native (PRAME_HUMAN)
QDIKMILKMVQLDSIEDL

SEQ ID NO: 346360 - protein, 19 aa, Homo sapiens
  Native (PRAME_HUMAN)
QDIKMILKMVQLDSIEDLE

SEQ ID NO: 346361 - protein, 20 aa, Homo sapiens
  Native (PRAME_HUMAN)
QDIKMILKMVQLDSIEDLEV

SEQ ID NO: 346362 - protein, 21 aa, Homo sapiens
  Native (PRAME_HUMAN)
QDIKMILKMVQLDSIEDLEVT

SEQ ID NO: 346363 - protein, 22 aa, Homo sapiens
  Native (PRAME_HUMAN)
QDIKMILKMVQLDSIEDLEVTC

SEQ ID NO: 346364 - protein, 23 aa, Homo sapiens
  Native (PRAME_HUMAN)
QDIKMILKMVQLDSIEDLEVTCT

SEQ ID NO: 346365 - protein, 24 aa, Homo sapiens
  Native (PRAME_HUMAN)
QDIKMILKMVQLDSIEDLEVTCTW

SEQ ID NO: 346366 - protein, 25 aa, Homo sapiens
  Native (PRAME_HUMAN)
QDIKMILKMVQLDSIEDLEVTCTWK

SEQ ID NO: 346367 - protein, 19 aa, Homo sapiens
  Native (PRAME_HUMAN)
QDLVFDECGITDDQLLALL

SEQ ID NO: 346368 - protein, 20 aa, Homo sapiens
  Native (PRAME_HUMAN)
QDLVFDECGITDDQLLALLP

SEQ ID NO: 346369 - protein, 21 aa, Homo sapiens
  Native (PRAME_HUMAN)
QDLVFDECGITDDQLLALLPS

SEQ ID NO: 346370 - protein, 22 aa, Homo sapiens
  Native (PRAME_HUMAN)
QDLVFDECGITDDQLLALLPSL

SEQ ID NO: 346371 - protein, 23 aa, Homo sapiens
  Native (PRAME_HUMAN)
QDLVFDECGITDDQLLALLPSLS

SEQ ID NO: 346372 - protein, 24 aa, Homo sapiens
  Native (PRAME_HUMAN)
QDLVFDECGITDDQLLALLPSLSH

SEQ ID NO: 346373 - protein, 25 aa, Homo sapiens
  Native (PRAME_HUMAN)
QDLVFDECGITDDQLLALLPSLSHC

SEQ ID NO: 346374 - protein, 15 aa, Homo sapiens
  Native (PRAME_HUMAN)
QEVRPRRWKLQVLDL

SEQ ID NO: 346375 - protein, 16 aa, Homo sapiens
  Native (PRAME_HUMAN)
QEVRPRRWKLQVLDLR

SEQ ID NO: 346376 - protein, 17 aa, Homo sapiens
  Native (PRAME_HUMAN)
QEVRPRRWKLQVLDLRK

SEQ ID NO: 346377 - protein, 18 aa, Homo sapiens
  Native (PRAME_HUMAN)
QEVRPRRWKLQVLDLRKN

SEQ ID NO: 346378 - protein, 19 aa, Homo sapiens
  Native (PRAME_HUMAN)
QEVRPRRWKLQVLDLRKNS

SEQ ID NO: 346379 - protein, 20 aa, Homo sapiens
  Native (PRAME_HUMAN)
QEVRPRRWKLQVLDLRKNSH

SEQ ID NO: 346380 - protein, 21 aa, Homo sapiens
  Native (PRAME_HUMAN)
QEVRPRRWKLQVLDLRKNSHQ

SEQ ID NO: 346381 - protein, 22 aa, Homo sapiens
  Native (PRAME_HUMAN)
QEVRPRRWKLQVLDLRKNSHQD

SEQ ID NO: 346382 - protein, 23 aa, Homo sapiens
  Native (PRAME_HUMAN)
QEVRPRRWKLQVLDLRKNSHQDF

SEQ ID NO: 346383 - protein, 24 aa, Homo sapiens
  Native (PRAME_HUMAN)
QEVRPRRWKLQVLDLRKNSHQDFW

SEQ ID NO: 346384 - protein, 25 aa, Homo sapiens
  Native (PRAME_HUMAN)
QEVRPRRWKLQVLDLRKNSHQDFWT

SEQ ID NO: 346385 - protein, 13 aa, Homo sapiens
  Native (PRAME_HUMAN)
QFLSLQCLQALYV

SEQ ID NO: 346386 - protein, 14 aa, Homo sapiens
  Native (PRAME_HUMAN)
QFLSLQCLQALYVD

SEQ ID NO: 346387 - protein, 15 aa, Homo sapiens
  Native (PRAME_HUMAN)
QFLSLQCLQALYVDS

SEQ ID NO: 346388 - protein, 16 aa, Homo sapiens
  Native (PRAME_HUMAN)
QFLSLQCLQALYVDSL

SEQ ID NO: 346389 - protein, 17 aa, Homo sapiens
  Native (PRAME_HUMAN)
QFLSLQCLQALYVDSLF

SEQ ID NO: 346390 - protein, 18 aa, Homo sapiens
  Native (PRAME_HUMAN)
QFLSLQCLQALYVDSLFF

SEQ ID NO: 346391 - protein, 19 aa, Homo sapiens
  Native (PRAME_HUMAN)
QFLSLQCLQALYVDSLFFL

SEQ ID NO: 346392 - protein, 20 aa, Homo sapiens
  Native (PRAME_HUMAN)
QFLSLQCLQALYVDSLFFLR

SEQ ID NO: 346393 - protein, 21 aa, Homo sapiens
  Native (PRAME_HUMAN)
QFLSLQCLQALYVDSLFFLRG

SEQ ID NO: 346394 - protein, 22 aa, Homo sapiens
  Native (PRAME_HUMAN)
QFLSLQCLQALYVDSLFFLRGR

SEQ ID NO: 346395 - protein, 23 aa, Homo sapiens
  Native (PRAME_HUMAN)
QFLSLQCLQALYVDSLFFLRGRL

SEQ ID NO: 346396 - protein, 24 aa, Homo sapiens
  Native (PRAME_HUMAN)
QFLSLQCLQALYVDSLFFLRGRLD

SEQ ID NO: 346397 - protein, 25 aa, Homo sapiens
  Native (PRAME_HUMAN)
QFLSLQCLQALYVDSLFFLRGRLDQ

SEQ ID NO: 346398 - protein, 13 aa, Homo sapiens
  Native (PRAME_HUMAN)
QFTSQFLSLQCLQ

SEQ ID NO: 346399 - protein, 14 aa, Homo sapiens
  Native (PRAME_HUMAN)
QFTSQFLSLQCLQA

SEQ ID NO: 346400 - protein, 15 aa, Homo sapiens
  Native (PRAME_HUMAN)
QFTSQFLSLQCLQAL

SEQ ID NO: 346401 - protein, 16 aa, Homo sapiens
  Native (PRAME_HUMAN)
QFTSQFLSLQCLQALY

SEQ ID NO: 346402 - protein, 17 aa, Homo sapiens
  Native (PRAME_HUMAN)
QFTSQFLSLQCLQALYV

SEQ ID NO: 346403 - protein, 18 aa, Homo sapiens
  Native (PRAME_HUMAN)
QFTSQFLSLQCLQALYVD

SEQ ID NO: 346404 - protein, 19 aa, Homo sapiens
  Native (PRAME_HUMAN)
QFTSQFLSLQCLQALYVDS

SEQ ID NO: 346405 - protein, 20 aa, Homo sapiens
  Native (PRAME_HUMAN)
QFTSQFLSLQCLQALYVDSL

SEQ ID NO: 346406 - protein, 21 aa, Homo sapiens
  Native (PRAME_HUMAN)
QFTSQFLSLQCLQALYVDSLF

SEQ ID NO: 346407 - protein, 22 aa, Homo sapiens
  Native (PRAME_HUMAN)
QFTSQFLSLQCLQALYVDSLFF

SEQ ID NO: 346408 - protein, 23 aa, Homo sapiens
  Native (PRAME_HUMAN)
QFTSQFLSLQCLQALYVDSLFFL

SEQ ID NO: 346409 - protein, 24 aa, Homo sapiens
  Native (PRAME_HUMAN)
QFTSQFLSLQCLQALYVDSLFFLR

SEQ ID NO: 346410 - protein, 25 aa, Homo sapiens
  Native (PRAME_HUMAN)
QFTSQFLSLQCLQALYVDSLFFLRG

SEQ ID NO: 346411 - protein, 13 aa, Homo sapiens
  Native (PRAME_HUMAN)
QHLHLETFKAVLD

SEQ ID NO: 346412 - protein, 14 aa, Homo sapiens
  Native (PRAME_HUMAN)
QHLHLETFKAVLDG

SEQ ID NO: 346413 - protein, 15 aa, Homo sapiens
  Native (PRAME_HUMAN)
QHLHLETFKAVLDGL

SEQ ID NO: 346414 - protein, 16 aa, Homo sapiens
  Native (PRAME_HUMAN)
QHLHLETFKAVLDGLD

SEQ ID NO: 346415 - protein, 17 aa, Homo sapiens
  Native (PRAME_HUMAN)
QHLHLETFKAVLDGLDV

SEQ ID NO: 346416 - protein, 18 aa, Homo sapiens
  Native (PRAME_HUMAN)
QHLHLETFKAVLDGLDVL

SEQ ID NO: 346417 - protein, 19 aa, Homo sapiens
  Native (PRAME_HUMAN)
QHLHLETFKAVLDGLDVLL

SEQ ID NO: 346418 - protein, 20 aa, Homo sapiens
  Native (PRAME_HUMAN)
QHLHLETFKAVLDGLDVLLA

SEQ ID NO: 346419 - protein, 21 aa, Homo sapiens
  Native (PRAME_HUMAN)
QHLHLETFKAVLDGLDVLLAQ

SEQ ID NO: 346420 - protein, 22 aa, Homo sapiens
  Native (PRAME_HUMAN)
QHLHLETFKAVLDGLDVLLAQE

SEQ ID NO: 346421 - protein, 23 aa, Homo sapiens
  Native (PRAME_HUMAN)
QHLHLETFKAVLDGLDVLLAQEV

SEQ ID NO: 346422 - protein, 24 aa, Homo sapiens
  Native (PRAME_HUMAN)
QHLHLETFKAVLDGLDVLLAQEVR

SEQ ID NO: 346423 - protein, 25 aa, Homo sapiens
  Native (PRAME_HUMAN)
QHLHLETFKAVLDGLDVLLAQEVRP

SEQ ID NO: 346424 - protein, 13 aa, Homo sapiens
  Native (PRAME_HUMAN)
QHLIGLSNLTHVL

SEQ ID NO: 346425 - protein, 14 aa, Homo sapiens
  Native (PRAME_HUMAN)
QHLIGLSNLTHVLY

SEQ ID NO: 346426 - protein, 15 aa, Homo sapiens
  Native (PRAME_HUMAN)
QHLIGLSNLTHVLYP

SEQ ID NO: 346427 - protein, 16 aa, Homo sapiens
  Native (PRAME_HUMAN)
QHLIGLSNLTHVLYPV

SEQ ID NO: 346428 - protein, 17 aa, Homo sapiens
  Native (PRAME_HUMAN)
QHLIGLSNLTHVLYPVP

SEQ ID NO: 346429 - protein, 18 aa, Homo sapiens
  Native (PRAME_HUMAN)
QHLIGLSNLTHVLYPVPL

SEQ ID NO: 346430 - protein, 19 aa, Homo sapiens
  Native (PRAME_HUMAN)
QHLIGLSNLTHVLYPVPLE

SEQ ID NO: 346431 - protein, 20 aa, Homo sapiens
  Native (PRAME_HUMAN)
QHLIGLSNLTHVLYPVPLES

SEQ ID NO: 346432 - protein, 21 aa, Homo sapiens
  Native (PRAME_HUMAN)
QHLIGLSNLTHVLYPVPLESY

SEQ ID NO: 346433 - protein, 22 aa, Homo sapiens
  Native (PRAME_HUMAN)
QHLIGLSNLTHVLYPVPLESYE

SEQ ID NO: 346434 - protein, 23 aa, Homo sapiens
  Native (PRAME_HUMAN)
QHLIGLSNLTHVLYPVPLESYED

SEQ ID NO: 346435 - protein, 24 aa, Homo sapiens
  Native (PRAME_HUMAN)
QHLIGLSNLTHVLYPVPLESYEDI

SEQ ID NO: 346436 - protein, 25 aa, Homo sapiens
  Native (PRAME_HUMAN)
QHLIGLSNLTHVLYPVPLESYEDIH

SEQ ID NO: 346437 - protein, 15 aa, Homo sapiens
  Native (PRAME_HUMAN)
QLDSIEDLEVTCTWK

SEQ ID NO: 346438 - protein, 16 aa, Homo sapiens
  Native (PRAME_HUMAN)
QLDSIEDLEVTCTWKL

SEQ ID NO: 346439 - protein, 17 aa, Homo sapiens
  Native (PRAME_HUMAN)
QLDSIEDLEVTCTWKLP

SEQ ID NO: 346440 - protein, 19 aa, Homo sapiens
  Native (PRAME_HUMAN)
QLDSIEDLEVTCTWKLPTL

SEQ ID NO: 346441 - protein, 20 aa, Homo sapiens
  Native (PRAME_HUMAN)
QLDSIEDLEVTCTWKLPTLA

SEQ ID NO: 346442 - protein, 21 aa, Homo sapiens
  Native (PRAME_HUMAN)
QLDSIEDLEVTCTWKLPTLAK

SEQ ID NO: 346443 - protein, 22 aa, Homo sapiens
  Native (PRAME_HUMAN)
QLDSIEDLEVTCTWKLPTLAKF

SEQ ID NO: 346444 - protein, 23 aa, Homo sapiens
  Native (PRAME_HUMAN)
QLDSIEDLEVTCTWKLPTLAKFS

SEQ ID NO: 346445 - protein, 24 aa, Homo sapiens
  Native (PRAME_HUMAN)
QLDSIEDLEVTCTWKLPTLAKFSP

SEQ ID NO: 346446 - protein, 25 aa, Homo sapiens
  Native (PRAME_HUMAN)
QLDSIEDLEVTCTWKLPTLAKFSPY

SEQ ID NO: 346447 - protein, 13 aa, Homo sapiens
  Native (PRAME_HUMAN)
QLLALLPSLSHCS

SEQ ID NO: 346448 - protein, 14 aa, Homo sapiens
  Native (PRAME_HUMAN)
QLLALLPSLSHCSQ

SEQ ID NO: 346449 - protein, 16 aa, Homo sapiens
  Native (PRAME_HUMAN)
QLLALLPSLSHCSQLT

SEQ ID NO: 346450 - protein, 17 aa, Homo sapiens
  Native (PRAME_HUMAN)
QLLALLPSLSHCSQLTT

SEQ ID NO: 346451 - protein, 18 aa, Homo sapiens
  Native (PRAME_HUMAN)
QLLALLPSLSHCSQLTTL

SEQ ID NO: 346452 - protein, 19 aa, Homo sapiens
  Native (PRAME_HUMAN)
QLLALLPSLSHCSQLTTLS

SEQ ID NO: 346453 - protein, 20 aa, Homo sapiens
  Native (PRAME_HUMAN)
QLLALLPSLSHCSQLTTLSF

SEQ ID NO: 346454 - protein, 21 aa, Homo sapiens
  Native (PRAME_HUMAN)
QLLALLPSLSHCSQLTTLSFY

SEQ ID NO: 346455 - protein, 22 aa, Homo sapiens
  Native (PRAME_HUMAN)
QLLALLPSLSHCSQLTTLSFYG

SEQ ID NO: 346456 - protein, 23 aa, Homo sapiens
  Native (PRAME_HUMAN)
QLLALLPSLSHCSQLTTLSFYGN

SEQ ID NO: 346457 - protein, 24 aa, Homo sapiens
  Native (PRAME_HUMAN)
QLLALLPSLSHCSQLTTLSFYGNS

SEQ ID NO: 346458 - protein, 25 aa, Homo sapiens
  Native (PRAME_HUMAN)
QLLALLPSLSHCSQLTTLSFYGNSI

SEQ ID NO: 346459 - protein, 13 aa, Homo sapiens
  Native (PRAME_HUMAN)
QLLRHVMNPLETL

SEQ ID NO: 346460 - protein, 14 aa, Homo sapiens
  Native (PRAME_HUMAN)
QLLRHVMNPLETLS

SEQ ID NO: 346461 - protein, 15 aa, Homo sapiens
  Native (PRAME_HUMAN)
QLLRHVMNPLETLSI

SEQ ID NO: 346462 - protein, 16 aa, Homo sapiens
  Native (PRAME_HUMAN)
QLLRHVMNPLETLSIT

SEQ ID NO: 346463 - protein, 17 aa, Homo sapiens
  Native (PRAME_HUMAN)
QLLRHVMNPLETLSITN

SEQ ID NO: 346464 - protein, 18 aa, Homo sapiens
  Native (PRAME_HUMAN)
QLLRHVMNPLETLSITNC

SEQ ID NO: 346465 - protein, 19 aa, Homo sapiens
  Native (PRAME_HUMAN)
QLLRHVMNPLETLSITNCR

SEQ ID NO: 346466 - protein, 20 aa, Homo sapiens
  Native (PRAME_HUMAN)
QLLRHVMNPLETLSITNCRL

SEQ ID NO: 346467 - protein, 21 aa, Homo sapiens
  Native (PRAME_HUMAN)
QLLRHVMNPLETLSITNCRLS

SEQ ID NO: 346468 - protein, 22 aa, Homo sapiens
  Native (PRAME_HUMAN)
QLLRHVMNPLETLSITNCRLSE

SEQ ID NO: 346469 - protein, 23 aa, Homo sapiens
  Native (PRAME_HUMAN)
QLLRHVMNPLETLSITNCRLSEG

SEQ ID NO: 346470 - protein, 24 aa, Homo sapiens
  Native (PRAME_HUMAN)
QLLRHVMNPLETLSITNCRLSEGD

SEQ ID NO: 346471 - protein, 25 aa, Homo sapiens
  Native (PRAME_HUMAN)
QLLRHVMNPLETLSITNCRLSEGDV

SEQ ID NO: 346472 - protein, 13 aa, Homo sapiens
  Native (PRAME_HUMAN)
QLSVLSLSGVMLT

SEQ ID NO: 346473 - protein, 14 aa, Homo sapiens
  Native (PRAME_HUMAN)
QLSVLSLSGVMLTD

SEQ ID NO: 346474 - protein, 15 aa, Homo sapiens
  Native (PRAME_HUMAN)
QLSVLSLSGVMLTDV

SEQ ID NO: 346475 - protein, 16 aa, Homo sapiens
  Native (PRAME_HUMAN)
QLSVLSLSGVMLTDVS

SEQ ID NO: 346476 - protein, 17 aa, Homo sapiens
  Native (PRAME_HUMAN)
QLSVLSLSGVMLTDVSP

SEQ ID NO: 346477 - protein, 18 aa, Homo sapiens
  Native (PRAME_HUMAN)
QLSVLSLSGVMLTDVSPE

SEQ ID NO: 346478 - protein, 19 aa, Homo sapiens
  Native (PRAME_HUMAN)
QLSVLSLSGVMLTDVSPEP

SEQ ID NO: 346479 - protein, 20 aa, Homo sapiens
  Native (PRAME_HUMAN)
QLSVLSLSGVMLTDVSPEPL

SEQ ID NO: 346480 - protein, 21 aa, Homo sapiens
  Native (PRAME_HUMAN)
QLSVLSLSGVMLTDVSPEPLQ

SEQ ID NO: 346481 - protein, 22 aa, Homo sapiens
  Native (PRAME_HUMAN)
QLSVLSLSGVMLTDVSPEPLQA

SEQ ID NO: 346482 - protein, 23 aa, Homo sapiens
  Native (PRAME_HUMAN)
QLSVLSLSGVMLTDVSPEPLQAL

SEQ ID NO: 346483 - protein, 24 aa, Homo sapiens
  Native (PRAME_HUMAN)
QLSVLSLSGVMLTDVSPEPLQALL

SEQ ID NO: 346484 - protein, 25 aa, Homo sapiens
  Native (PRAME_HUMAN)
QLSVLSLSGVMLTDVSPEPLQALLE

SEQ ID NO: 346485 - protein, 13 aa, Homo sapiens
  Native (PRAME_HUMAN)
QLTTLSFYGNSIS

SEQ ID NO: 346486 - protein, 14 aa, Homo sapiens
  Native (PRAME_HUMAN)
QLTTLSFYGNSISI

SEQ ID NO: 346487 - protein, 15 aa, Homo sapiens
  Native (PRAME_HUMAN)
QLTTLSFYGNSISIS

SEQ ID NO: 346488 - protein, 16 aa, Homo sapiens
  Native (PRAME_HUMAN)
QLTTLSFYGNSISISA

SEQ ID NO: 346489 - protein, 18 aa, Homo sapiens
  Native (PRAME_HUMAN)
QLTTLSFYGNSISISALQ

SEQ ID NO: 346490 - protein, 19 aa, Homo sapiens
  Native (PRAME_HUMAN)
QLTTLSFYGNSISISALQS

SEQ ID NO: 346491 - protein, 20 aa, Homo sapiens
  Native (PRAME_HUMAN)
QLTTLSFYGNSISISALQSL

SEQ ID NO: 346492 - protein, 21 aa, Homo sapiens
  Native (PRAME_HUMAN)
QLTTLSFYGNSISISALQSLL

SEQ ID NO: 346493 - protein, 22 aa, Homo sapiens
  Native (PRAME_HUMAN)
QLTTLSFYGNSISISALQSLLQ

SEQ ID NO: 346494 - protein, 23 aa, Homo sapiens
  Native (PRAME_HUMAN)
QLTTLSFYGNSISISALQSLLQH

SEQ ID NO: 346495 - protein, 24 aa, Homo sapiens
  Native (PRAME_HUMAN)
QLTTLSFYGNSISISALQSLLQHL

SEQ ID NO: 346496 - protein, 25 aa, Homo sapiens
  Native (PRAME_HUMAN)
QLTTLSFYGNSISISALQSLLQHLI

SEQ ID NO: 346497 - protein, 13 aa, Homo sapiens
  Native (PRAME_HUMAN)
QMINLRRLLLSHI

SEQ ID NO: 346498 - protein, 14 aa, Homo sapiens
  Native (PRAME_HUMAN)
QMINLRRLLLSHIH

SEQ ID NO: 346499 - protein, 15 aa, Homo sapiens
  Native (PRAME_HUMAN)
QMINLRRLLLSHIHA

SEQ ID NO: 346500 - protein, 16 aa, Homo sapiens
  Native (PRAME_HUMAN)
QMINLRRLLLSHIHAS

SEQ ID NO: 346501 - protein, 17 aa, Homo sapiens
  Native (PRAME_HUMAN)
QMINLRRLLLSHIHASS

SEQ ID NO: 346502 - protein, 18 aa, Homo sapiens
  Native (PRAME_HUMAN)
QMINLRRLLLSHIHASSY

SEQ ID NO: 346503 - protein, 19 aa, Homo sapiens
  Native (PRAME_HUMAN)
QMINLRRLLLSHIHASSYI

SEQ ID NO: 346504 - protein, 20 aa, Homo sapiens
  Native (PRAME_HUMAN)
QMINLRRLLLSHIHASSYIS

SEQ ID NO: 346505 - protein, 21 aa, Homo sapiens
  Native (PRAME_HUMAN)
QMINLRRLLLSHIHASSYISP

SEQ ID NO: 346506 - protein, 22 aa, Homo sapiens
  Native (PRAME_HUMAN)
QMINLRRLLLSHIHASSYISPE

SEQ ID NO: 346507 - protein, 23 aa, Homo sapiens
  Native (PRAME_HUMAN)
QMINLRRLLLSHIHASSYISPEK

SEQ ID NO: 346508 - protein, 24 aa, Homo sapiens
  Native (PRAME_HUMAN)
QMINLRRLLLSHIHASSYISPEKE

SEQ ID NO: 346509 - protein, 25 aa, Homo sapiens
  Native (PRAME_HUMAN)
QMINLRRLLLSHIHASSYISPEKEE

SEQ ID NO: 346510 - protein, 13 aa, Homo sapiens
  Native (PRAME_HUMAN)
QPFIPVEVLVDLF

SEQ ID NO: 346511 - protein, 14 aa, Homo sapiens
  Native (PRAME_HUMAN)
QPFIPVEVLVDLFL

SEQ ID NO: 346512 - protein, 15 aa, Homo sapiens
  Native (PRAME_HUMAN)
QPFIPVEVLVDLFLK

SEQ ID NO: 346513 - protein, 16 aa, Homo sapiens
  Native (PRAME_HUMAN)
QPFIPVEVLVDLFLKE

SEQ ID NO: 346514 - protein, 17 aa, Homo sapiens
  Native (PRAME_HUMAN)
QPFIPVEVLVDLFLKEG

SEQ ID NO: 346515 - protein, 18 aa, Homo sapiens
  Native (PRAME_HUMAN)
QPFIPVEVLVDLFLKEGA

SEQ ID NO: 346516 - protein, 19 aa, Homo sapiens
  Native (PRAME_HUMAN)
QPFIPVEVLVDLFLKEGAC

SEQ ID NO: 346517 - protein, 20 aa, Homo sapiens
  Native (PRAME_HUMAN)
QPFIPVEVLVDLFLKEGACD

SEQ ID NO: 346518 - protein, 21 aa, Homo sapiens
  Native (PRAME_HUMAN)
QPFIPVEVLVDLFLKEGACDE

SEQ ID NO: 346519 - protein, 22 aa, Homo sapiens
  Native (PRAME_HUMAN)
QPFIPVEVLVDLFLKEGACDEL

SEQ ID NO: 346520 - protein, 23 aa, Homo sapiens
  Native (PRAME_HUMAN)
QPFIPVEVLVDLFLKEGACDELF

SEQ ID NO: 346521 - protein, 24 aa, Homo sapiens
  Native (PRAME_HUMAN)
QPFIPVEVLVDLFLKEGACDELFS

SEQ ID NO: 346522 - protein, 25 aa, Homo sapiens
  Native (PRAME_HUMAN)
QPFIPVEVLVDLFLKEGACDELFSY

SEQ ID NO: 346523 - protein, 15 aa, Homo sapiens
  Native (PRAME_HUMAN)
QPMTKKRKVDGLSTE

SEQ ID NO: 346524 - protein, 20 aa, Homo sapiens
  Native (PRAME_HUMAN)
QPMTKKRKVDGLSTEAEQPF

SEQ ID NO: 346525 - protein, 21 aa, Homo sapiens
  Native (PRAME_HUMAN)
QPMTKKRKVDGLSTEAEQPFI

SEQ ID NO: 346526 - protein, 22 aa, Homo sapiens
  Native (PRAME_HUMAN)
QPMTKKRKVDGLSTEAEQPFIP

SEQ ID NO: 346527 - protein, 23 aa, Homo sapiens
  Native (PRAME_HUMAN)
QPMTKKRKVDGLSTEAEQPFIPV

SEQ ID NO: 346528 - protein, 24 aa, Homo sapiens
  Native (PRAME_HUMAN)
QPMTKKRKVDGLSTEAEQPFIPVE

SEQ ID NO: 346529 - protein, 25 aa, Homo sapiens
  Native (PRAME_HUMAN)
QPMTKKRKVDGLSTEAEQPFIPVEV

SEQ ID NO: 346530 - protein, 13 aa, Homo sapiens
  Native (PRAME_HUMAN)
QSLLKDEALAIAA

SEQ ID NO: 346531 - protein, 14 aa, Homo sapiens
  Native (PRAME_HUMAN)
QSLLKDEALAIAAL

SEQ ID NO: 346532 - protein, 16 aa, Homo sapiens
  Native (PRAME_HUMAN)
QSLLKDEALAIAALEL

SEQ ID NO: 346533 - protein, 17 aa, Homo sapiens
  Native (PRAME_HUMAN)
QSLLKDEALAIAALELL

SEQ ID NO: 346534 - protein, 18 aa, Homo sapiens
  Native (PRAME_HUMAN)
QSLLKDEALAIAALELLP

SEQ ID NO: 346535 - protein, 19 aa, Homo sapiens
  Native (PRAME_HUMAN)
QSLLKDEALAIAALELLPR

SEQ ID NO: 346536 - protein, 20 aa, Homo sapiens
  Native (PRAME_HUMAN)
QSLLKDEALAIAALELLPRE

SEQ ID NO: 346537 - protein, 21 aa, Homo sapiens
  Native (PRAME_HUMAN)
QSLLKDEALAIAALELLPREL

SEQ ID NO: 346538 - protein, 22 aa, Homo sapiens
  Native (PRAME_HUMAN)
QSLLKDEALAIAALELLPRELF

SEQ ID NO: 346539 - protein, 23 aa, Homo sapiens
  Native (PRAME_HUMAN)
QSLLKDEALAIAALELLPRELFP

SEQ ID NO: 346540 - protein, 24 aa, Homo sapiens
  Native (PRAME_HUMAN)
QSLLKDEALAIAALELLPRELFPP

SEQ ID NO: 346541 - protein, 25 aa, Homo sapiens
  Native (PRAME_HUMAN)
QSLLKDEALAIAALELLPRELFPPL

SEQ ID NO: 346542 - protein, 13 aa, Homo sapiens
  Native (PRAME_HUMAN)
QSLLQHLIGLSNL

SEQ ID NO: 346543 - protein, 14 aa, Homo sapiens
  Native (PRAME_HUMAN)
QSLLQHLIGLSNLT

SEQ ID NO: 346544 - protein, 15 aa, Homo sapiens
  Native (PRAME_HUMAN)
QSLLQHLIGLSNLTH

SEQ ID NO: 346545 - protein, 16 aa, Homo sapiens
  Native (PRAME_HUMAN)
QSLLQHLIGLSNLTHV

SEQ ID NO: 346546 - protein, 17 aa, Homo sapiens
  Native (PRAME_HUMAN)
QSLLQHLIGLSNLTHVL

SEQ ID NO: 346547 - protein, 18 aa, Homo sapiens
  Native (PRAME_HUMAN)
QSLLQHLIGLSNLTHVLY

SEQ ID NO: 346548 - protein, 19 aa, Homo sapiens
  Native (PRAME_HUMAN)
QSLLQHLIGLSNLTHVLYP

SEQ ID NO: 346549 - protein, 21 aa, Homo sapiens
  Native (PRAME_HUMAN)
QSLLQHLIGLSNLTHVLYPVP

SEQ ID NO: 346550 - protein, 22 aa, Homo sapiens
  Native (PRAME_HUMAN)
QSLLQHLIGLSNLTHVLYPVPL

SEQ ID NO: 346551 - protein, 23 aa, Homo sapiens
  Native (PRAME_HUMAN)
QSLLQHLIGLSNLTHVLYPVPLE

SEQ ID NO: 346552 - protein, 24 aa, Homo sapiens
  Native (PRAME_HUMAN)
QSLLQHLIGLSNLTHVLYPVPLES

SEQ ID NO: 346553 - protein, 25 aa, Homo sapiens
  Native (PRAME_HUMAN)
QSLLQHLIGLSNLTHVLYPVPLESY

SEQ ID NO: 346554 - protein, 14 aa, Homo sapiens
  Native (PRAME_HUMAN)
QSPSVSQLSVLSLS

SEQ ID NO: 346555 - protein, 15 aa, Homo sapiens
  Native (PRAME_HUMAN)
QSPSVSQLSVLSLSG

SEQ ID NO: 346556 - protein, 16 aa, Homo sapiens
  Native (PRAME_HUMAN)
QSPSVSQLSVLSLSGV

SEQ ID NO: 346557 - protein, 17 aa, Homo sapiens
  Native (PRAME_HUMAN)
QSPSVSQLSVLSLSGVM

SEQ ID NO: 346558 - protein, 18 aa, Homo sapiens
  Native (PRAME_HUMAN)
QSPSVSQLSVLSLSGVML

SEQ ID NO: 346559 - protein, 19 aa, Homo sapiens
  Native (PRAME_HUMAN)
QSPSVSQLSVLSLSGVMLT

SEQ ID NO: 346560 - protein, 20 aa, Homo sapiens
  Native (PRAME_HUMAN)
QSPSVSQLSVLSLSGVMLTD

SEQ ID NO: 346561 - protein, 21 aa, Homo sapiens
  Native (PRAME_HUMAN)
QSPSVSQLSVLSLSGVMLTDV

SEQ ID NO: 346562 - protein, 22 aa, Homo sapiens
  Native (PRAME_HUMAN)
QSPSVSQLSVLSLSGVMLTDVS

SEQ ID NO: 346563 - protein, 23 aa, Homo sapiens
  Native (PRAME_HUMAN)
QSPSVSQLSVLSLSGVMLTDVSP

SEQ ID NO: 346564 - protein, 24 aa, Homo sapiens
  Native (PRAME_HUMAN)
QSPSVSQLSVLSLSGVMLTDVSPE

SEQ ID NO: 346565 - protein, 25 aa, Homo sapiens
  Native (PRAME_HUMAN)
QSPSVSQLSVLSLSGVMLTDVSPEP

SEQ ID NO: 346566 - protein, 13 aa, Homo sapiens
  Native (PRAME_HUMAN)
QSRYISMSVWTSP

SEQ ID NO: 346567 - protein, 14 aa, Homo sapiens
  Native (PRAME_HUMAN)
QSRYISMSVWTSPR

SEQ ID NO: 346568 - protein, 15 aa, Homo sapiens
  Native (PRAME_HUMAN)
QSRYISMSVWTSPRR

SEQ ID NO: 346569 - protein, 16 aa, Homo sapiens
  Native (PRAME_HUMAN)
QSRYISMSVWTSPRRL

SEQ ID NO: 346570 - protein, 17 aa, Homo sapiens
  Native (PRAME_HUMAN)
QSRYISMSVWTSPRRLV

SEQ ID NO: 346571 - protein, 18 aa, Homo sapiens
  Native (PRAME_HUMAN)
QSRYISMSVWTSPRRLVE

SEQ ID NO: 346572 - protein, 19 aa, Homo sapiens
  Native (PRAME_HUMAN)
QSRYISMSVWTSPRRLVEL

SEQ ID NO: 346573 - protein, 20 aa, Homo sapiens
  Native (PRAME_HUMAN)
QSRYISMSVWTSPRRLVELA

SEQ ID NO: 346574 - protein, 21 aa, Homo sapiens
  Native (PRAME_HUMAN)
QSRYISMSVWTSPRRLVELAG

SEQ ID NO: 346575 - protein, 22 aa, Homo sapiens
  Native (PRAME_HUMAN)
QSRYISMSVWTSPRRLVELAGQ

SEQ ID NO: 346576 - protein, 23 aa, Homo sapiens
  Native (PRAME_HUMAN)
QSRYISMSVWTSPRRLVELAGQS

SEQ ID NO: 346577 - protein, 24 aa, Homo sapiens
  Native (PRAME_HUMAN)
QSRYISMSVWTSPRRLVELAGQSL

SEQ ID NO: 346578 - protein, 25 aa, Homo sapiens
  Native (PRAME_HUMAN)
QSRYISMSVWTSPRRLVELAGQSLL

SEQ ID NO: 346579 - protein, 14 aa, Homo sapiens
  Native (PRAME_HUMAN)
QTLKAMVQAWPFTC

SEQ ID NO: 346580 - protein, 15 aa, Homo sapiens
  Native (PRAME_HUMAN)
QTLKAMVQAWPFTCL

SEQ ID NO: 346581 - protein, 16 aa, Homo sapiens
  Native (PRAME_HUMAN)
QTLKAMVQAWPFTCLP

SEQ ID NO: 346582 - protein, 17 aa, Homo sapiens
  Native (PRAME_HUMAN)
QTLKAMVQAWPFTCLPL

SEQ ID NO: 346583 - protein, 18 aa, Homo sapiens
  Native (PRAME_HUMAN)
QTLKAMVQAWPFTCLPLG

SEQ ID NO: 346584 - protein, 19 aa, Homo sapiens
  Native (PRAME_HUMAN)
QTLKAMVQAWPFTCLPLGV

SEQ ID NO: 346585 - protein, 20 aa, Homo sapiens
  Native (PRAME_HUMAN)
QTLKAMVQAWPFTCLPLGVL

SEQ ID NO: 346586 - protein, 21 aa, Homo sapiens
  Native (PRAME_HUMAN)
QTLKAMVQAWPFTCLPLGVLM

SEQ ID NO: 346587 - protein, 22 aa, Homo sapiens
  Native (PRAME_HUMAN)
QTLKAMVQAWPFTCLPLGVLMK

SEQ ID NO: 346588 - protein, 23 aa, Homo sapiens
  Native (PRAME_HUMAN)
QTLKAMVQAWPFTCLPLGVLMKG

SEQ ID NO: 346589 - protein, 24 aa, Homo sapiens
  Native (PRAME_HUMAN)
QTLKAMVQAWPFTCLPLGVLMKGQ

SEQ ID NO: 346590 - protein, 25 aa, Homo sapiens
  Native (PRAME_HUMAN)
QTLKAMVQAWPFTCLPLGVLMKGQH

SEQ ID NO: 346591 - protein, 14 aa, Homo sapiens
  Native (PRAME_HUMAN)
QVLDLRKNSHQDFW

SEQ ID NO: 346592 - protein, 15 aa, Homo sapiens
  Native (PRAME_HUMAN)
QVLDLRKNSHQDFWT

SEQ ID NO: 346593 - protein, 16 aa, Homo sapiens
  Native (PRAME_HUMAN)
QVLDLRKNSHQDFWTV

SEQ ID NO: 346594 - protein, 17 aa, Homo sapiens
  Native (PRAME_HUMAN)
QVLDLRKNSHQDFWTVW

SEQ ID NO: 346595 - protein, 18 aa, Homo sapiens
  Native (PRAME_HUMAN)
QVLDLRKNSHQDFWTVWS

SEQ ID NO: 346596 - protein, 19 aa, Homo sapiens
  Native (PRAME_HUMAN)
QVLDLRKNSHQDFWTVWSG

SEQ ID NO: 346597 - protein, 20 aa, Homo sapiens
  Native (PRAME_HUMAN)
QVLDLRKNSHQDFWTVWSGN

SEQ ID NO: 346598 - protein, 21 aa, Homo sapiens
  Native (PRAME_HUMAN)
QVLDLRKNSHQDFWTVWSGNR

SEQ ID NO: 346599 - protein, 22 aa, Homo sapiens
  Native (PRAME_HUMAN)
QVLDLRKNSHQDFWTVWSGNRA

SEQ ID NO: 346600 - protein, 23 aa, Homo sapiens
  Native (PRAME_HUMAN)
QVLDLRKNSHQDFWTVWSGNRAS

SEQ ID NO: 346601 - protein, 24 aa, Homo sapiens
  Native (PRAME_HUMAN)
QVLDLRKNSHQDFWTVWSGNRASL

SEQ ID NO: 346602 - protein, 25 aa, Homo sapiens
  Native (PRAME_HUMAN)
QVLDLRKNSHQDFWTVWSGNRASLY

SEQ ID NO: 346603 - protein, 13 aa, Homo sapiens
  Native (PRAME_HUMAN)
QYIAQFTSQFLSL

SEQ ID NO: 346604 - protein, 14 aa, Homo sapiens
  Native (PRAME_HUMAN)
QYIAQFTSQFLSLQ

SEQ ID NO: 346605 - protein, 15 aa, Homo sapiens
  Native (PRAME_HUMAN)
QYIAQFTSQFLSLQC

SEQ ID NO: 346606 - protein, 16 aa, Homo sapiens
  Native (PRAME_HUMAN)
QYIAQFTSQFLSLQCL

SEQ ID NO: 346607 - protein, 17 aa, Homo sapiens
  Native (PRAME_HUMAN)
QYIAQFTSQFLSLQCLQ

SEQ ID NO: 346608 - protein, 18 aa, Homo sapiens
  Native (PRAME_HUMAN)
QYIAQFTSQFLSLQCLQA

SEQ ID NO: 346609 - protein, 19 aa, Homo sapiens
  Native (PRAME_HUMAN)
QYIAQFTSQFLSLQCLQAL

SEQ ID NO: 346610 - protein, 20 aa, Homo sapiens
  Native (PRAME_HUMAN)
QYIAQFTSQFLSLQCLQALY

SEQ ID NO: 346611 - protein, 21 aa, Homo sapiens
  Native (PRAME_HUMAN)
QYIAQFTSQFLSLQCLQALYV

SEQ ID NO: 346612 - protein, 22 aa, Homo sapiens
  Native (PRAME_HUMAN)
QYIAQFTSQFLSLQCLQALYVD

SEQ ID NO: 346613 - protein, 23 aa, Homo sapiens
  Native (PRAME_HUMAN)
QYIAQFTSQFLSLQCLQALYVDS

SEQ ID NO: 346614 - protein, 24 aa, Homo sapiens
  Native (PRAME_HUMAN)
QYIAQFTSQFLSLQCLQALYVDSL

SEQ ID NO: 346615 - protein, 25 aa, Homo sapiens
  Native (PRAME_HUMAN)
QYIAQFTSQFLSLQCLQALYVDSLF

SEQ ID NO: 346616 - protein, 14 aa, Homo sapiens
  Native (PRAME_HUMAN)
RASATLQDLVFDEC

SEQ ID NO: 346617 - protein, 15 aa, Homo sapiens
  Native (PRAME_HUMAN)
RASATLQDLVFDECG

SEQ ID NO: 346618 - protein, 16 aa, Homo sapiens
  Native (PRAME_HUMAN)
RASATLQDLVFDECGI

SEQ ID NO: 346619 - protein, 17 aa, Homo sapiens
  Native (PRAME_HUMAN)
RASATLQDLVFDECGIT

SEQ ID NO: 346620 - protein, 19 aa, Homo sapiens
  Native (PRAME_HUMAN)
RASATLQDLVFDECGITDD

SEQ ID NO: 346621 - protein, 20 aa, Homo sapiens
  Native (PRAME_HUMAN)
RASATLQDLVFDECGITDDQ

SEQ ID NO: 346622 - protein, 21 aa, Homo sapiens
  Native (PRAME_HUMAN)
RASATLQDLVFDECGITDDQL

SEQ ID NO: 346623 - protein, 22 aa, Homo sapiens
  Native (PRAME_HUMAN)
RASATLQDLVFDECGITDDQLL

SEQ ID NO: 346624 - protein, 23 aa, Homo sapiens
  Native (PRAME_HUMAN)
RASATLQDLVFDECGITDDQLLA

SEQ ID NO: 346625 - protein, 24 aa, Homo sapiens
  Native (PRAME_HUMAN)
RASATLQDLVFDECGITDDQLLAL

SEQ ID NO: 346626 - protein, 25 aa, Homo sapiens
  Native (PRAME_HUMAN)
RASATLQDLVFDECGITDDQLLALL

SEQ ID NO: 346627 - protein, 14 aa, Homo sapiens
  Native (PRAME_HUMAN)
RASLYSFPEPEAAQ

SEQ ID NO: 346628 - protein, 15 aa, Homo sapiens
  Native (PRAME_HUMAN)
RASLYSFPEPEAAQP

SEQ ID NO: 346629 - protein, 16 aa, Homo sapiens
  Native (PRAME_HUMAN)
RASLYSFPEPEAAQPM

SEQ ID NO: 346630 - protein, 17 aa, Homo sapiens
  Native (PRAME_HUMAN)
RASLYSFPEPEAAQPMT

SEQ ID NO: 346631 - protein, 19 aa, Homo sapiens
  Native (PRAME_HUMAN)
RASLYSFPEPEAAQPMTKK

SEQ ID NO: 346632 - protein, 20 aa, Homo sapiens
  Native (PRAME_HUMAN)
RASLYSFPEPEAAQPMTKKR

SEQ ID NO: 346633 - protein, 21 aa, Homo sapiens
  Native (PRAME_HUMAN)
RASLYSFPEPEAAQPMTKKRK

SEQ ID NO: 346634 - protein, 22 aa, Homo sapiens
  Native (PRAME_HUMAN)
RASLYSFPEPEAAQPMTKKRKV

SEQ ID NO: 346635 - protein, 23 aa, Homo sapiens
  Native (PRAME_HUMAN)
RASLYSFPEPEAAQPMTKKRKVD

SEQ ID NO: 346636 - protein, 24 aa, Homo sapiens
  Native (PRAME_HUMAN)
RASLYSFPEPEAAQPMTKKRKVDG

SEQ ID NO: 346637 - protein, 25 aa, Homo sapiens
  Native (PRAME_HUMAN)
RASLYSFPEPEAAQPMTKKRKVDGL

SEQ ID NO: 346638 - protein, 13 aa, Homo sapiens
  Native (PRAME_HUMAN)
RELFPPLFMAAFD

SEQ ID NO: 346639 - protein, 14 aa, Homo sapiens
  Native (PRAME_HUMAN)
RELFPPLFMAAFDG

SEQ ID NO: 346640 - protein, 15 aa, Homo sapiens
  Native (PRAME_HUMAN)
RELFPPLFMAAFDGR

SEQ ID NO: 346641 - protein, 16 aa, Homo sapiens
  Native (PRAME_HUMAN)
RELFPPLFMAAFDGRH

SEQ ID NO: 346642 - protein, 17 aa, Homo sapiens
  Native (PRAME_HUMAN)
RELFPPLFMAAFDGRHS

SEQ ID NO: 346643 - protein, 18 aa, Homo sapiens
  Native (PRAME_HUMAN)
RELFPPLFMAAFDGRHSQ

SEQ ID NO: 346644 - protein, 19 aa, Homo sapiens
  Native (PRAME_HUMAN)
RELFPPLFMAAFDGRHSQT

SEQ ID NO: 346645 - protein, 20 aa, Homo sapiens
  Native (PRAME_HUMAN)
RELFPPLFMAAFDGRHSQTL

SEQ ID NO: 346646 - protein, 21 aa, Homo sapiens
  Native (PRAME_HUMAN)
RELFPPLFMAAFDGRHSQTLK

SEQ ID NO: 346647 - protein, 22 aa, Homo sapiens
  Native (PRAME_HUMAN)
RELFPPLFMAAFDGRHSQTLKA

SEQ ID NO: 346648 - protein, 23 aa, Homo sapiens
  Native (PRAME_HUMAN)
RELFPPLFMAAFDGRHSQTLKAM

SEQ ID NO: 346649 - protein, 24 aa, Homo sapiens
  Native (PRAME_HUMAN)
RELFPPLFMAAFDGRHSQTLKAMV

SEQ ID NO: 346650 - protein, 25 aa, Homo sapiens
  Native (PRAME_HUMAN)
RELFPPLFMAAFDGRHSQTLKAMVQ

SEQ ID NO: 346651 - protein, 13 aa, Homo sapiens
  Native (PRAME_HUMAN)
RELLCELGRPSMV

SEQ ID NO: 346652 - protein, 14 aa, Homo sapiens
  Native (PRAME_HUMAN)
RELLCELGRPSMVW

SEQ ID NO: 346653 - protein, 16 aa, Homo sapiens
  Native (PRAME_HUMAN)
RELLCELGRPSMVWLS

SEQ ID NO: 346654 - protein, 17 aa, Homo sapiens
  Native (PRAME_HUMAN)
RELLCELGRPSMVWLSA

SEQ ID NO: 346655 - protein, 18 aa, Homo sapiens
  Native (PRAME_HUMAN)
RELLCELGRPSMVWLSAN

SEQ ID NO: 346656 - protein, 19 aa, Homo sapiens
  Native (PRAME_HUMAN)
RELLCELGRPSMVWLSANP

SEQ ID NO: 346657 - protein, 20 aa, Homo sapiens
  Native (PRAME_HUMAN)
RELLCELGRPSMVWLSANPC

SEQ ID NO: 346658 - protein, 21 aa, Homo sapiens
  Native (PRAME_HUMAN)
RELLCELGRPSMVWLSANPCP

SEQ ID NO: 346659 - protein, 22 aa, Homo sapiens
  Native (PRAME_HUMAN)
RELLCELGRPSMVWLSANPCPH

SEQ ID NO: 346660 - protein, 23 aa, Homo sapiens
  Native (PRAME_HUMAN)
RELLCELGRPSMVWLSANPCPHC

SEQ ID NO: 346661 - protein, 24 aa, Homo sapiens
  Native (PRAME_HUMAN)
RELLCELGRPSMVWLSANPCPHCG

SEQ ID NO: 346662 - protein, 25 aa, Homo sapiens
  Native (PRAME_HUMAN)
RELLCELGRPSMVWLSANPCPHCGD

SEQ ID NO: 346663 - protein, 14 aa, Homo sapiens
  Native (PRAME_HUMAN)
RGRLDQLLRHVMNP

SEQ ID NO: 346664 - protein, 15 aa, Homo sapiens
  Native (PRAME_HUMAN)
RGRLDQLLRHVMNPL

SEQ ID NO: 346665 - protein, 16 aa, Homo sapiens
  Native (PRAME_HUMAN)
RGRLDQLLRHVMNPLE

SEQ ID NO: 346666 - protein, 17 aa, Homo sapiens
  Native (PRAME_HUMAN)
RGRLDQLLRHVMNPLET

SEQ ID NO: 346667 - protein, 18 aa, Homo sapiens
  Native (PRAME_HUMAN)
RGRLDQLLRHVMNPLETL

SEQ ID NO: 346668 - protein, 19 aa, Homo sapiens
  Native (PRAME_HUMAN)
RGRLDQLLRHVMNPLETLS

SEQ ID NO: 346669 - protein, 20 aa, Homo sapiens
  Native (PRAME_HUMAN)
RGRLDQLLRHVMNPLETLSI

SEQ ID NO: 346670 - protein, 21 aa, Homo sapiens
  Native (PRAME_HUMAN)
RGRLDQLLRHVMNPLETLSIT

SEQ ID NO: 346671 - protein, 22 aa, Homo sapiens
  Native (PRAME_HUMAN)
RGRLDQLLRHVMNPLETLSITN

SEQ ID NO: 346672 - protein, 23 aa, Homo sapiens
  Native (PRAME_HUMAN)
RGRLDQLLRHVMNPLETLSITNC

SEQ ID NO: 346673 - protein, 24 aa, Homo sapiens
  Native (PRAME_HUMAN)
RGRLDQLLRHVMNPLETLSITNCR

SEQ ID NO: 346674 - protein, 25 aa, Homo sapiens
  Native (PRAME_HUMAN)
RGRLDQLLRHVMNPLETLSITNCRL

SEQ ID NO: 346675 - protein, 15 aa, Homo sapiens
  Native (PRAME_HUMAN)
RHSQTLKAMVQAWPF

SEQ ID NO: 346676 - protein, 16 aa, Homo sapiens
  Native (PRAME_HUMAN)
RHSQTLKAMVQAWPFT

SEQ ID NO: 346677 - protein, 17 aa, Homo sapiens
  Native (PRAME_HUMAN)
RHSQTLKAMVQAWPFTC

SEQ ID NO: 346678 - protein, 18 aa, Homo sapiens
  Native (PRAME_HUMAN)
RHSQTLKAMVQAWPFTCL

SEQ ID NO: 346679 - protein, 19 aa, Homo sapiens
  Native (PRAME_HUMAN)
RHSQTLKAMVQAWPFTCLP

SEQ ID NO: 346680 - protein, 20 aa, Homo sapiens
  Native (PRAME_HUMAN)
RHSQTLKAMVQAWPFTCLPL

SEQ ID NO: 346681 - protein, 21 aa, Homo sapiens
  Native (PRAME_HUMAN)
RHSQTLKAMVQAWPFTCLPLG

SEQ ID NO: 346682 - protein, 22 aa, Homo sapiens
  Native (PRAME_HUMAN)
RHSQTLKAMVQAWPFTCLPLGV

SEQ ID NO: 346683 - protein, 23 aa, Homo sapiens
  Native (PRAME_HUMAN)
RHSQTLKAMVQAWPFTCLPLGVL

SEQ ID NO: 346684 - protein, 24 aa, Homo sapiens
  Native (PRAME_HUMAN)
RHSQTLKAMVQAWPFTCLPLGVLM

SEQ ID NO: 346685 - protein, 25 aa, Homo sapiens
  Native (PRAME_HUMAN)
RHSQTLKAMVQAWPFTCLPLGVLMK

SEQ ID NO: 346686 - protein, 14 aa, Homo sapiens
  Native (PRAME_HUMAN)
RHVMNPLETLSITN

SEQ ID NO: 346687 - protein, 15 aa, Homo sapiens
  Native (PRAME_HUMAN)
RHVMNPLETLSITNC

SEQ ID NO: 346688 - protein, 16 aa, Homo sapiens
  Native (PRAME_HUMAN)
RHVMNPLETLSITNCR

SEQ ID NO: 346689 - protein, 17 aa, Homo sapiens
  Native (PRAME_HUMAN)
RHVMNPLETLSITNCRL

SEQ ID NO: 346690 - protein, 18 aa, Homo sapiens
  Native (PRAME_HUMAN)
RHVMNPLETLSITNCRLS

SEQ ID NO: 346691 - protein, 19 aa, Homo sapiens
  Native (PRAME_HUMAN)
RHVMNPLETLSITNCRLSE

SEQ ID NO: 346692 - protein, 20 aa, Homo sapiens
  Native (PRAME_HUMAN)
RHVMNPLETLSITNCRLSEG

SEQ ID NO: 346693 - protein, 21 aa, Homo sapiens
  Native (PRAME_HUMAN)
RHVMNPLETLSITNCRLSEGD

SEQ ID NO: 346694 - protein, 22 aa, Homo sapiens
  Native (PRAME_HUMAN)
RHVMNPLETLSITNCRLSEGDV

SEQ ID NO: 346695 - protein, 23 aa, Homo sapiens
  Native (PRAME_HUMAN)
RHVMNPLETLSITNCRLSEGDVM

SEQ ID NO: 346696 - protein, 24 aa, Homo sapiens
  Native (PRAME_HUMAN)
RHVMNPLETLSITNCRLSEGDVMH

SEQ ID NO: 346697 - protein, 25 aa, Homo sapiens
  Native (PRAME_HUMAN)
RHVMNPLETLSITNCRLSEGDVMHL

SEQ ID NO: 346698 - protein, 14 aa, Homo sapiens
  Native (PRAME_HUMAN)
RKKNVLRLCCKKLK

SEQ ID NO: 346699 - protein, 15 aa, Homo sapiens
  Native (PRAME_HUMAN)
RKKNVLRLCCKKLKI

SEQ ID NO: 346700 - protein, 16 aa, Homo sapiens
  Native (PRAME_HUMAN)
RKKNVLRLCCKKLKIF

SEQ ID NO: 346701 - protein, 18 aa, Homo sapiens
  Native (PRAME_HUMAN)
RKKNVLRLCCKKLKIFAM

SEQ ID NO: 346702 - protein, 19 aa, Homo sapiens
  Native (PRAME_HUMAN)
RKKNVLRLCCKKLKIFAMP

SEQ ID NO: 346703 - protein, 20 aa, Homo sapiens
  Native (PRAME_HUMAN)
RKKNVLRLCCKKLKIFAMPM

SEQ ID NO: 346704 - protein, 21 aa, Homo sapiens
  Native (PRAME_HUMAN)
RKKNVLRLCCKKLKIFAMPMQ

SEQ ID NO: 346705 - protein, 22 aa, Homo sapiens
  Native (PRAME_HUMAN)
RKKNVLRLCCKKLKIFAMPMQD

SEQ ID NO: 346706 - protein, 23 aa, Homo sapiens
  Native (PRAME_HUMAN)
RKKNVLRLCCKKLKIFAMPMQDI

SEQ ID NO: 346707 - protein, 24 aa, Homo sapiens
  Native (PRAME_HUMAN)
RKKNVLRLCCKKLKIFAMPMQDIK

SEQ ID NO: 346708 - protein, 25 aa, Homo sapiens
  Native (PRAME_HUMAN)
RKKNVLRLCCKKLKIFAMPMQDIKM

SEQ ID NO: 346709 - protein, 16 aa, Homo sapiens
  Native (PRAME_HUMAN)
RKNSHQDFWTVWSGNR

SEQ ID NO: 346710 - protein, 17 aa, Homo sapiens
  Native (PRAME_HUMAN)
RKNSHQDFWTVWSGNRA

SEQ ID NO: 346711 - protein, 18 aa, Homo sapiens
  Native (PRAME_HUMAN)
RKNSHQDFWTVWSGNRAS

SEQ ID NO: 346712 - protein, 19 aa, Homo sapiens
  Native (PRAME_HUMAN)
RKNSHQDFWTVWSGNRASL

SEQ ID NO: 346713 - protein, 20 aa, Homo sapiens
  Native (PRAME_HUMAN)
RKNSHQDFWTVWSGNRASLY

SEQ ID NO: 346714 - protein, 21 aa, Homo sapiens
  Native (PRAME_HUMAN)
RKNSHQDFWTVWSGNRASLYS

SEQ ID NO: 346715 - protein, 22 aa, Homo sapiens
  Native (PRAME_HUMAN)
RKNSHQDFWTVWSGNRASLYSF

SEQ ID NO: 346716 - protein, 23 aa, Homo sapiens
  Native (PRAME_HUMAN)
RKNSHQDFWTVWSGNRASLYSFP

SEQ ID NO: 346717 - protein, 24 aa, Homo sapiens
  Native (PRAME_HUMAN)
RKNSHQDFWTVWSGNRASLYSFPE

SEQ ID NO: 346718 - protein, 25 aa, Homo sapiens
  Native (PRAME_HUMAN)
RKNSHQDFWTVWSGNRASLYSFPEP

SEQ ID NO: 346719 - protein, 14 aa, Homo sapiens
  Native (PRAME_HUMAN)
RKVDGLSTEAEQPF

SEQ ID NO: 346720 - protein, 15 aa, Homo sapiens
  Native (PRAME_HUMAN)
RKVDGLSTEAEQPFI

SEQ ID NO: 346721 - protein, 16 aa, Homo sapiens
  Native (PRAME_HUMAN)
RKVDGLSTEAEQPFIP

SEQ ID NO: 346722 - protein, 17 aa, Homo sapiens
  Native (PRAME_HUMAN)
RKVDGLSTEAEQPFIPV

SEQ ID NO: 346723 - protein, 18 aa, Homo sapiens
  Native (PRAME_HUMAN)
RKVDGLSTEAEQPFIPVE

SEQ ID NO: 346724 - protein, 19 aa, Homo sapiens
  Native (PRAME_HUMAN)
RKVDGLSTEAEQPFIPVEV

SEQ ID NO: 346725 - protein, 20 aa, Homo sapiens
  Native (PRAME_HUMAN)
RKVDGLSTEAEQPFIPVEVL

SEQ ID NO: 346726 - protein, 21 aa, Homo sapiens
  Native (PRAME_HUMAN)
RKVDGLSTEAEQPFIPVEVLV

SEQ ID NO: 346727 - protein, 22 aa, Homo sapiens
  Native (PRAME_HUMAN)
RKVDGLSTEAEQPFIPVEVLVD

SEQ ID NO: 346728 - protein, 23 aa, Homo sapiens
  Native (PRAME_HUMAN)
RKVDGLSTEAEQPFIPVEVLVDL

SEQ ID NO: 346729 - protein, 24 aa, Homo sapiens
  Native (PRAME_HUMAN)
RKVDGLSTEAEQPFIPVEVLVDLF

SEQ ID NO: 346730 - protein, 25 aa, Homo sapiens
  Native (PRAME_HUMAN)
RKVDGLSTEAEQPFIPVEVLVDLFL

SEQ ID NO: 346731 - protein, 13 aa, Homo sapiens
  Native (PRAME_HUMAN)
RLAYLHARLRELL

SEQ ID NO: 346732 - protein, 14 aa, Homo sapiens
  Native (PRAME_HUMAN)
RLAYLHARLRELLC

SEQ ID NO: 346733 - protein, 15 aa, Homo sapiens
  Native (PRAME_HUMAN)
RLAYLHARLRELLCE

SEQ ID NO: 346734 - protein, 16 aa, Homo sapiens
  Native (PRAME_HUMAN)
RLAYLHARLRELLCEL

SEQ ID NO: 346735 - protein, 17 aa, Homo sapiens
  Native (PRAME_HUMAN)
RLAYLHARLRELLCELG

SEQ ID NO: 346736 - protein, 18 aa, Homo sapiens
  Native (PRAME_HUMAN)
RLAYLHARLRELLCELGR

SEQ ID NO: 346737 - protein, 19 aa, Homo sapiens
  Native (PRAME_HUMAN)
RLAYLHARLRELLCELGRP

SEQ ID NO: 346738 - protein, 20 aa, Homo sapiens
  Native (PRAME_HUMAN)
RLAYLHARLRELLCELGRPS

SEQ ID NO: 346739 - protein, 21 aa, Homo sapiens
  Native (PRAME_HUMAN)
RLAYLHARLRELLCELGRPSM

SEQ ID NO: 346740 - protein, 22 aa, Homo sapiens
  Native (PRAME_HUMAN)
RLAYLHARLRELLCELGRPSMV

SEQ ID NO: 346741 - protein, 23 aa, Homo sapiens
  Native (PRAME_HUMAN)
RLAYLHARLRELLCELGRPSMVW

SEQ ID NO: 346742 - protein, 24 aa, Homo sapiens
  Native (PRAME_HUMAN)
RLAYLHARLRELLCELGRPSMVWL

SEQ ID NO: 346743 - protein, 25 aa, Homo sapiens
  Native (PRAME_HUMAN)
RLAYLHARLRELLCELGRPSMVWLS

SEQ ID NO: 346744 - protein, 14 aa, Homo sapiens
  Native (PRAME_HUMAN)
RLCCKKLKIFAMPM

SEQ ID NO: 346745 - protein, 15 aa, Homo sapiens
  Native (PRAME_HUMAN)
RLCCKKLKIFAMPMQ

SEQ ID NO: 346746 - protein, 16 aa, Homo sapiens
  Native (PRAME_HUMAN)
RLCCKKLKIFAMPMQD

SEQ ID NO: 346747 - protein, 17 aa, Homo sapiens
  Native (PRAME_HUMAN)
RLCCKKLKIFAMPMQDI

SEQ ID NO: 346748 - protein, 18 aa, Homo sapiens
  Native (PRAME_HUMAN)
RLCCKKLKIFAMPMQDIK

SEQ ID NO: 346749 - protein, 19 aa, Homo sapiens
  Native (PRAME_HUMAN)
RLCCKKLKIFAMPMQDIKM

SEQ ID NO: 346750 - protein, 20 aa, Homo sapiens
  Native (PRAME_HUMAN)
RLCCKKLKIFAMPMQDIKMI

SEQ ID NO: 346751 - protein, 21 aa, Homo sapiens
  Native (PRAME_HUMAN)
RLCCKKLKIFAMPMQDIKMIL

SEQ ID NO: 346752 - protein, 22 aa, Homo sapiens
  Native (PRAME_HUMAN)
RLCCKKLKIFAMPMQDIKMILK

SEQ ID NO: 346753 - protein, 23 aa, Homo sapiens
  Native (PRAME_HUMAN)
RLCCKKLKIFAMPMQDIKMILKM

SEQ ID NO: 346754 - protein, 24 aa, Homo sapiens
  Native (PRAME_HUMAN)
RLCCKKLKIFAMPMQDIKMILKMV

SEQ ID NO: 346755 - protein, 25 aa, Homo sapiens
  Native (PRAME_HUMAN)
RLCCKKLKIFAMPMQDIKMILKMVQ

SEQ ID NO: 346756 - protein, 13 aa, Homo sapiens
  Native (PRAME_HUMAN)
RLDQLLRHVMNPL

SEQ ID NO: 346757 - protein, 14 aa, Homo sapiens
  Native (PRAME_HUMAN)
RLDQLLRHVMNPLE

SEQ ID NO: 346758 - protein, 15 aa, Homo sapiens
  Native (PRAME_HUMAN)
RLDQLLRHVMNPLET

SEQ ID NO: 346759 - protein, 16 aa, Homo sapiens
  Native (PRAME_HUMAN)
RLDQLLRHVMNPLETL

SEQ ID NO: 346760 - protein, 17 aa, Homo sapiens
  Native (PRAME_HUMAN)
RLDQLLRHVMNPLETLS

SEQ ID NO: 346761 - protein, 18 aa, Homo sapiens
  Native (PRAME_HUMAN)
RLDQLLRHVMNPLETLSI

SEQ ID NO: 346762 - protein, 19 aa, Homo sapiens
  Native (PRAME_HUMAN)
RLDQLLRHVMNPLETLSIT

SEQ ID NO: 346763 - protein, 20 aa, Homo sapiens
  Native (PRAME_HUMAN)
RLDQLLRHVMNPLETLSITN

SEQ ID NO: 346764 - protein, 21 aa, Homo sapiens
  Native (PRAME_HUMAN)
RLDQLLRHVMNPLETLSITNC

SEQ ID NO: 346765 - protein, 22 aa, Homo sapiens
  Native (PRAME_HUMAN)
RLDQLLRHVMNPLETLSITNCR

SEQ ID NO: 346766 - protein, 23 aa, Homo sapiens
  Native (PRAME_HUMAN)
RLDQLLRHVMNPLETLSITNCRL

SEQ ID NO: 346767 - protein, 24 aa, Homo sapiens
  Native (PRAME_HUMAN)
RLDQLLRHVMNPLETLSITNCRLS

SEQ ID NO: 346768 - protein, 25 aa, Homo sapiens
  Native (PRAME_HUMAN)
RLDQLLRHVMNPLETLSITNCRLSE

SEQ ID NO: 346769 - protein, 13 aa, Homo sapiens
  Native (PRAME_HUMAN)
RLLLSHIHASSYI

SEQ ID NO: 346770 - protein, 14 aa, Homo sapiens
  Native (PRAME_HUMAN)
RLLLSHIHASSYIS

SEQ ID NO: 346771 - protein, 15 aa, Homo sapiens
  Native (PRAME_HUMAN)
RLLLSHIHASSYISP

SEQ ID NO: 346772 - protein, 16 aa, Homo sapiens
  Native (PRAME_HUMAN)
RLLLSHIHASSYISPE

SEQ ID NO: 346773 - protein, 17 aa, Homo sapiens
  Native (PRAME_HUMAN)
RLLLSHIHASSYISPEK

SEQ ID NO: 346774 - protein, 18 aa, Homo sapiens
  Native (PRAME_HUMAN)
RLLLSHIHASSYISPEKE

SEQ ID NO: 346775 - protein, 19 aa, Homo sapiens
  Native (PRAME_HUMAN)
RLLLSHIHASSYISPEKEE

SEQ ID NO: 346776 - protein, 20 aa, Homo sapiens
  Native (PRAME_HUMAN)
RLLLSHIHASSYISPEKEEQ

SEQ ID NO: 346777 - protein, 21 aa, Homo sapiens
  Native (PRAME_HUMAN)
RLLLSHIHASSYISPEKEEQY

SEQ ID NO: 346778 - protein, 22 aa, Homo sapiens
  Native (PRAME_HUMAN)
RLLLSHIHASSYISPEKEEQYI

SEQ ID NO: 346779 - protein, 23 aa, Homo sapiens
  Native (PRAME_HUMAN)
RLLLSHIHASSYISPEKEEQYIA

SEQ ID NO: 346780 - protein, 24 aa, Homo sapiens
  Native (PRAME_HUMAN)
RLLLSHIHASSYISPEKEEQYIAQ

SEQ ID NO: 346781 - protein, 25 aa, Homo sapiens
  Native (PRAME_HUMAN)
RLLLSHIHASSYISPEKEEQYIAQF

SEQ ID NO: 346782 - protein, 14 aa, Homo sapiens
  Native (PRAME_HUMAN)
RLRELLCELGRPSM

SEQ ID NO: 346783 - protein, 15 aa, Homo sapiens
  Native (PRAME_HUMAN)
RLRELLCELGRPSMV

SEQ ID NO: 346784 - protein, 16 aa, Homo sapiens
  Native (PRAME_HUMAN)
RLRELLCELGRPSMVW

SEQ ID NO: 346785 - protein, 17 aa, Homo sapiens
  Native (PRAME_HUMAN)
RLRELLCELGRPSMVWL

SEQ ID NO: 346786 - protein, 18 aa, Homo sapiens
  Native (PRAME_HUMAN)
RLRELLCELGRPSMVWLS

SEQ ID NO: 346787 - protein, 19 aa, Homo sapiens
  Native (PRAME_HUMAN)
RLRELLCELGRPSMVWLSA

SEQ ID NO: 346788 - protein, 20 aa, Homo sapiens
  Native (PRAME_HUMAN)
RLRELLCELGRPSMVWLSAN

SEQ ID NO: 346789 - protein, 21 aa, Homo sapiens
  Native (PRAME_HUMAN)
RLRELLCELGRPSMVWLSANP

SEQ ID NO: 346790 - protein, 22 aa, Homo sapiens
  Native (PRAME_HUMAN)
RLRELLCELGRPSMVWLSANPC

SEQ ID NO: 346791 - protein, 23 aa, Homo sapiens
  Native (PRAME_HUMAN)
RLRELLCELGRPSMVWLSANPCP

SEQ ID NO: 346792 - protein, 24 aa, Homo sapiens
  Native (PRAME_HUMAN)
RLRELLCELGRPSMVWLSANPCPH

SEQ ID NO: 346793 - protein, 25 aa, Homo sapiens
  Native (PRAME_HUMAN)
RLRELLCELGRPSMVWLSANPCPHC

SEQ ID NO: 346794 - protein, 16 aa, Homo sapiens
  Native (PRAME_HUMAN)
RLSEGDVMHLSQSPSV

SEQ ID NO: 346795 - protein, 17 aa, Homo sapiens
  Native (PRAME_HUMAN)
RLSEGDVMHLSQSPSVS

SEQ ID NO: 346796 - protein, 19 aa, Homo sapiens
  Native (PRAME_HUMAN)
RLSEGDVMHLSQSPSVSQL

SEQ ID NO: 346797 - protein, 20 aa, Homo sapiens
  Native (PRAME_HUMAN)
RLSEGDVMHLSQSPSVSQLS

SEQ ID NO: 346798 - protein, 21 aa, Homo sapiens
  Native (PRAME_HUMAN)
RLSEGDVMHLSQSPSVSQLSV

SEQ ID NO: 346799 - protein, 22 aa, Homo sapiens
  Native (PRAME_HUMAN)
RLSEGDVMHLSQSPSVSQLSVL

SEQ ID NO: 346800 - protein, 23 aa, Homo sapiens
  Native (PRAME_HUMAN)
RLSEGDVMHLSQSPSVSQLSVLS

SEQ ID NO: 346801 - protein, 24 aa, Homo sapiens
  Native (PRAME_HUMAN)
RLSEGDVMHLSQSPSVSQLSVLSL

SEQ ID NO: 346802 - protein, 25 aa, Homo sapiens
  Native (PRAME_HUMAN)
RLSEGDVMHLSQSPSVSQLSVLSLS

SEQ ID NO: 346803 - protein, 13 aa, Homo sapiens
  Native (PRAME_HUMAN)
RLVELAGQSLLKD

SEQ ID NO: 346804 - protein, 14 aa, Homo sapiens
  Native (PRAME_HUMAN)
RLVELAGQSLLKDE

SEQ ID NO: 346805 - protein, 15 aa, Homo sapiens
  Native (PRAME_HUMAN)
RLVELAGQSLLKDEA

SEQ ID NO: 346806 - protein, 16 aa, Homo sapiens
  Native (PRAME_HUMAN)
RLVELAGQSLLKDEAL

SEQ ID NO: 346807 - protein, 17 aa, Homo sapiens
  Native (PRAME_HUMAN)
RLVELAGQSLLKDEALA

SEQ ID NO: 346808 - protein, 18 aa, Homo sapiens
  Native (PRAME_HUMAN)
RLVELAGQSLLKDEALAI

SEQ ID NO: 346809 - protein, 19 aa, Homo sapiens
  Native (PRAME_HUMAN)
RLVELAGQSLLKDEALAIA

SEQ ID NO: 346810 - protein, 20 aa, Homo sapiens
  Native (PRAME_HUMAN)
RLVELAGQSLLKDEALAIAA

SEQ ID NO: 346811 - protein, 21 aa, Homo sapiens
  Native (PRAME_HUMAN)
RLVELAGQSLLKDEALAIAAL

SEQ ID NO: 346812 - protein, 22 aa, Homo sapiens
  Native (PRAME_HUMAN)
RLVELAGQSLLKDEALAIAALE

SEQ ID NO: 346813 - protein, 23 aa, Homo sapiens
  Native (PRAME_HUMAN)
RLVELAGQSLLKDEALAIAALEL

SEQ ID NO: 346814 - protein, 24 aa, Homo sapiens
  Native (PRAME_HUMAN)
RLVELAGQSLLKDEALAIAALELL

SEQ ID NO: 346815 - protein, 25 aa, Homo sapiens
  Native (PRAME_HUMAN)
RLVELAGQSLLKDEALAIAALELLP

SEQ ID NO: 346816 - protein, 13 aa, Homo sapiens
  Native (PRAME_HUMAN)
RLWGSIQSRYISM

SEQ ID NO: 346817 - protein, 14 aa, Homo sapiens
  Native (PRAME_HUMAN)
RLWGSIQSRYISMS

SEQ ID NO: 346818 - protein, 15 aa, Homo sapiens
  Native (PRAME_HUMAN)
RLWGSIQSRYISMSV

SEQ ID NO: 346819 - protein, 16 aa, Homo sapiens
  Native (PRAME_HUMAN)
RLWGSIQSRYISMSVW

SEQ ID NO: 346820 - protein, 17 aa, Homo sapiens
  Native (PRAME_HUMAN)
RLWGSIQSRYISMSVWT

SEQ ID NO: 346821 - protein, 18 aa, Homo sapiens
  Native (PRAME_HUMAN)
RLWGSIQSRYISMSVWTS

SEQ ID NO: 346822 - protein, 19 aa, Homo sapiens
  Native (PRAME_HUMAN)
RLWGSIQSRYISMSVWTSP

SEQ ID NO: 346823 - protein, 20 aa, Homo sapiens
  Native (PRAME_HUMAN)
RLWGSIQSRYISMSVWTSPR

SEQ ID NO: 346824 - protein, 21 aa, Homo sapiens
  Native (PRAME_HUMAN)
RLWGSIQSRYISMSVWTSPRR

SEQ ID NO: 346825 - protein, 22 aa, Homo sapiens
  Native (PRAME_HUMAN)
RLWGSIQSRYISMSVWTSPRRL

SEQ ID NO: 346826 - protein, 23 aa, Homo sapiens
  Native (PRAME_HUMAN)
RLWGSIQSRYISMSVWTSPRRLV

SEQ ID NO: 346827 - protein, 24 aa, Homo sapiens
  Native (PRAME_HUMAN)
RLWGSIQSRYISMSVWTSPRRLVE

SEQ ID NO: 346828 - protein, 25 aa, Homo sapiens
  Native (PRAME_HUMAN)
RLWGSIQSRYISMSVWTSPRRLVEL

SEQ ID NO: 346829 - protein, 13 aa, Homo sapiens
  Native (PRAME_HUMAN)
RPRRWKLQVLDLR

SEQ ID NO: 346830 - protein, 14 aa, Homo sapiens
  Native (PRAME_HUMAN)
RPRRWKLQVLDLRK

SEQ ID NO: 346831 - protein, 15 aa, Homo sapiens
  Native (PRAME_HUMAN)
RPRRWKLQVLDLRKN

SEQ ID NO: 346832 - protein, 16 aa, Homo sapiens
  Native (PRAME_HUMAN)
RPRRWKLQVLDLRKNS

SEQ ID NO: 346833 - protein, 17 aa, Homo sapiens
  Native (PRAME_HUMAN)
RPRRWKLQVLDLRKNSH

SEQ ID NO: 346834 - protein, 18 aa, Homo sapiens
  Native (PRAME_HUMAN)
RPRRWKLQVLDLRKNSHQ

SEQ ID NO: 346835 - protein, 19 aa, Homo sapiens
  Native (PRAME_HUMAN)
RPRRWKLQVLDLRKNSHQD

SEQ ID NO: 346836 - protein, 20 aa, Homo sapiens
  Native (PRAME_HUMAN)
RPRRWKLQVLDLRKNSHQDF

SEQ ID NO: 346837 - protein, 21 aa, Homo sapiens
  Native (PRAME_HUMAN)
RPRRWKLQVLDLRKNSHQDFW

SEQ ID NO: 346838 - protein, 22 aa, Homo sapiens
  Native (PRAME_HUMAN)
RPRRWKLQVLDLRKNSHQDFWT

SEQ ID NO: 346839 - protein, 23 aa, Homo sapiens
  Native (PRAME_HUMAN)
RPRRWKLQVLDLRKNSHQDFWTV

SEQ ID NO: 346840 - protein, 24 aa, Homo sapiens
  Native (PRAME_HUMAN)
RPRRWKLQVLDLRKNSHQDFWTVW

SEQ ID NO: 346841 - protein, 25 aa, Homo sapiens
  Native (PRAME_HUMAN)
RPRRWKLQVLDLRKNSHQDFWTVWS

SEQ ID NO: 346842 - protein, 13 aa, Homo sapiens
  Native (PRAME_HUMAN)
RPSMVWLSANPCP

SEQ ID NO: 346843 - protein, 14 aa, Homo sapiens
  Native (PRAME_HUMAN)
RPSMVWLSANPCPH

SEQ ID NO: 346844 - protein, 15 aa, Homo sapiens
  Native (PRAME_HUMAN)
RPSMVWLSANPCPHC

SEQ ID NO: 346845 - protein, 16 aa, Homo sapiens
  Native (PRAME_HUMAN)
RPSMVWLSANPCPHCG

SEQ ID NO: 346846 - protein, 17 aa, Homo sapiens
  Native (PRAME_HUMAN)
RPSMVWLSANPCPHCGD

SEQ ID NO: 346847 - protein, 18 aa, Homo sapiens
  Native (PRAME_HUMAN)
RPSMVWLSANPCPHCGDR

SEQ ID NO: 346848 - protein, 19 aa, Homo sapiens
  Native (PRAME_HUMAN)
RPSMVWLSANPCPHCGDRT

SEQ ID NO: 346849 - protein, 21 aa, Homo sapiens
  Native (PRAME_HUMAN)
RPSMVWLSANPCPHCGDRTFY

SEQ ID NO: 346850 - protein, 22 aa, Homo sapiens
  Native (PRAME_HUMAN)
RPSMVWLSANPCPHCGDRTFYD

SEQ ID NO: 346851 - protein, 23 aa, Homo sapiens
  Native (PRAME_HUMAN)
RPSMVWLSANPCPHCGDRTFYDP

SEQ ID NO: 346852 - protein, 24 aa, Homo sapiens
  Native (PRAME_HUMAN)
RPSMVWLSANPCPHCGDRTFYDPE

SEQ ID NO: 346853 - protein, 25 aa, Homo sapiens
  Native (PRAME_HUMAN)
RPSMVWLSANPCPHCGDRTFYDPEP

SEQ ID NO: 346854 - protein, 13 aa, Homo sapiens
  Native (PRAME_HUMAN)
RRLLLSHIHASSY

SEQ ID NO: 346855 - protein, 14 aa, Homo sapiens
  Native (PRAME_HUMAN)
RRLLLSHIHASSYI

SEQ ID NO: 346856 - protein, 15 aa, Homo sapiens
  Native (PRAME_HUMAN)
RRLLLSHIHASSYIS

SEQ ID NO: 346857 - protein, 16 aa, Homo sapiens
  Native (PRAME_HUMAN)
RRLLLSHIHASSYISP

SEQ ID NO: 346858 - protein, 17 aa, Homo sapiens
  Native (PRAME_HUMAN)
RRLLLSHIHASSYISPE

SEQ ID NO: 346859 - protein, 18 aa, Homo sapiens
  Native (PRAME_HUMAN)
RRLLLSHIHASSYISPEK

SEQ ID NO: 346860 - protein, 19 aa, Homo sapiens
  Native (PRAME_HUMAN)
RRLLLSHIHASSYISPEKE

SEQ ID NO: 346861 - protein, 21 aa, Homo sapiens
  Native (PRAME_HUMAN)
RRLLLSHIHASSYISPEKEEQ

SEQ ID NO: 346862 - protein, 22 aa, Homo sapiens
  Native (PRAME_HUMAN)
RRLLLSHIHASSYISPEKEEQY

SEQ ID NO: 346863 - protein, 23 aa, Homo sapiens
  Native (PRAME_HUMAN)
RRLLLSHIHASSYISPEKEEQYI

SEQ ID NO: 346864 - protein, 24 aa, Homo sapiens
  Native (PRAME_HUMAN)
RRLLLSHIHASSYISPEKEEQYIA

SEQ ID NO: 346865 - protein, 25 aa, Homo sapiens
  Native (PRAME_HUMAN)
RRLLLSHIHASSYISPEKEEQYIAQ

SEQ ID NO: 346866 - protein, 13 aa, Homo sapiens
  Native (PRAME_HUMAN)
RRLVELAGQSLLK

SEQ ID NO: 346867 - protein, 14 aa, Homo sapiens
  Native (PRAME_HUMAN)
RRLVELAGQSLLKD

SEQ ID NO: 346868 - protein, 15 aa, Homo sapiens
  Native (PRAME_HUMAN)
RRLVELAGQSLLKDE

SEQ ID NO: 346869 - protein, 16 aa, Homo sapiens
  Native (PRAME_HUMAN)
RRLVELAGQSLLKDEA

SEQ ID NO: 346870 - protein, 17 aa, Homo sapiens
  Native (PRAME_HUMAN)
RRLVELAGQSLLKDEAL

SEQ ID NO: 346871 - protein, 18 aa, Homo sapiens
  Native (PRAME_HUMAN)
RRLVELAGQSLLKDEALA

SEQ ID NO: 346872 - protein, 19 aa, Homo sapiens
  Native (PRAME_HUMAN)
RRLVELAGQSLLKDEALAI

SEQ ID NO: 346873 - protein, 20 aa, Homo sapiens
  Native (PRAME_HUMAN)
RRLVELAGQSLLKDEALAIA

SEQ ID NO: 346874 - protein, 21 aa, Homo sapiens
  Native (PRAME_HUMAN)
RRLVELAGQSLLKDEALAIAA

SEQ ID NO: 346875 - protein, 22 aa, Homo sapiens
  Native (PRAME_HUMAN)
RRLVELAGQSLLKDEALAIAAL

SEQ ID NO: 346876 - protein, 23 aa, Homo sapiens
  Native (PRAME_HUMAN)
RRLVELAGQSLLKDEALAIAALE

SEQ ID NO: 346877 - protein, 24 aa, Homo sapiens
  Native (PRAME_HUMAN)
RRLVELAGQSLLKDEALAIAALEL

SEQ ID NO: 346878 - protein, 25 aa, Homo sapiens
  Native (PRAME_HUMAN)
RRLVELAGQSLLKDEALAIAALELL

SEQ ID NO: 346879 - protein, 13 aa, Homo sapiens
  Native (PRAME_HUMAN)
RRLWGSIQSRYIS

SEQ ID NO: 346880 - protein, 14 aa, Homo sapiens
  Native (PRAME_HUMAN)
RRLWGSIQSRYISM

SEQ ID NO: 346881 - protein, 15 aa, Homo sapiens
  Native (PRAME_HUMAN)
RRLWGSIQSRYISMS

SEQ ID NO: 346882 - protein, 16 aa, Homo sapiens
  Native (PRAME_HUMAN)
RRLWGSIQSRYISMSV

SEQ ID NO: 346883 - protein, 17 aa, Homo sapiens
  Native (PRAME_HUMAN)
RRLWGSIQSRYISMSVW

SEQ ID NO: 346884 - protein, 18 aa, Homo sapiens
  Native (PRAME_HUMAN)
RRLWGSIQSRYISMSVWT

SEQ ID NO: 346885 - protein, 19 aa, Homo sapiens
  Native (PRAME_HUMAN)
RRLWGSIQSRYISMSVWTS

SEQ ID NO: 346886 - protein, 20 aa, Homo sapiens
  Native (PRAME_HUMAN)
RRLWGSIQSRYISMSVWTSP

SEQ ID NO: 346887 - protein, 21 aa, Homo sapiens
  Native (PRAME_HUMAN)
RRLWGSIQSRYISMSVWTSPR

SEQ ID NO: 346888 - protein, 22 aa, Homo sapiens
  Native (PRAME_HUMAN)
RRLWGSIQSRYISMSVWTSPRR

SEQ ID NO: 346889 - protein, 23 aa, Homo sapiens
  Native (PRAME_HUMAN)
RRLWGSIQSRYISMSVWTSPRRL

SEQ ID NO: 346890 - protein, 24 aa, Homo sapiens
  Native (PRAME_HUMAN)
RRLWGSIQSRYISMSVWTSPRRLV

SEQ ID NO: 346891 - protein, 25 aa, Homo sapiens
  Native (PRAME_HUMAN)
RRLWGSIQSRYISMSVWTSPRRLVE

SEQ ID NO: 346892 - protein, 13 aa, Homo sapiens
  Native (PRAME_HUMAN)
RRRLWGSIQSRYI

SEQ ID NO: 346893 - protein, 14 aa, Homo sapiens
  Native (PRAME_HUMAN)
RRRLWGSIQSRYIS

SEQ ID NO: 346894 - protein, 15 aa, Homo sapiens
  Native (PRAME_HUMAN)
RRRLWGSIQSRYISM

SEQ ID NO: 346895 - protein, 16 aa, Homo sapiens
  Native (PRAME_HUMAN)
RRRLWGSIQSRYISMS

SEQ ID NO: 346896 - protein, 17 aa, Homo sapiens
  Native (PRAME_HUMAN)
RRRLWGSIQSRYISMSV

SEQ ID NO: 346897 - protein, 18 aa, Homo sapiens
  Native (PRAME_HUMAN)
RRRLWGSIQSRYISMSVW

SEQ ID NO: 346898 - protein, 19 aa, Homo sapiens
  Native (PRAME_HUMAN)
RRRLWGSIQSRYISMSVWT

SEQ ID NO: 346899 - protein, 20 aa, Homo sapiens
  Native (PRAME_HUMAN)
RRRLWGSIQSRYISMSVWTS

SEQ ID NO: 346900 - protein, 21 aa, Homo sapiens
  Native (PRAME_HUMAN)
RRRLWGSIQSRYISMSVWTSP

SEQ ID NO: 346901 - protein, 22 aa, Homo sapiens
  Native (PRAME_HUMAN)
RRRLWGSIQSRYISMSVWTSPR

SEQ ID NO: 346902 - protein, 23 aa, Homo sapiens
  Native (PRAME_HUMAN)
RRRLWGSIQSRYISMSVWTSPRR

SEQ ID NO: 346903 - protein, 24 aa, Homo sapiens
  Native (PRAME_HUMAN)
RRRLWGSIQSRYISMSVWTSPRRL

SEQ ID NO: 346904 - protein, 25 aa, Homo sapiens
  Native (PRAME_HUMAN)
RRRLWGSIQSRYISMSVWTSPRRLV

SEQ ID NO: 346905 - protein, 13 aa, Homo sapiens
  Native (PRAME_HUMAN)
RRWKLQVLDLRKN

SEQ ID NO: 346906 - protein, 14 aa, Homo sapiens
  Native (PRAME_HUMAN)
RRWKLQVLDLRKNS

SEQ ID NO: 346907 - protein, 15 aa, Homo sapiens
  Native (PRAME_HUMAN)
RRWKLQVLDLRKNSH

SEQ ID NO: 346908 - protein, 16 aa, Homo sapiens
  Native (PRAME_HUMAN)
RRWKLQVLDLRKNSHQ

SEQ ID NO: 346909 - protein, 17 aa, Homo sapiens
  Native (PRAME_HUMAN)
RRWKLQVLDLRKNSHQD

SEQ ID NO: 346910 - protein, 18 aa, Homo sapiens
  Native (PRAME_HUMAN)
RRWKLQVLDLRKNSHQDF

SEQ ID NO: 346911 - protein, 19 aa, Homo sapiens
  Native (PRAME_HUMAN)
RRWKLQVLDLRKNSHQDFW

SEQ ID NO: 346912 - protein, 20 aa, Homo sapiens
  Native (PRAME_HUMAN)
RRWKLQVLDLRKNSHQDFWT

SEQ ID NO: 346913 - protein, 21 aa, Homo sapiens
  Native (PRAME_HUMAN)
RRWKLQVLDLRKNSHQDFWTV

SEQ ID NO: 346914 - protein, 22 aa, Homo sapiens
  Native (PRAME_HUMAN)
RRWKLQVLDLRKNSHQDFWTVW

SEQ ID NO: 346915 - protein, 23 aa, Homo sapiens
  Native (PRAME_HUMAN)
RRWKLQVLDLRKNSHQDFWTVWS

SEQ ID NO: 346916 - protein, 24 aa, Homo sapiens
  Native (PRAME_HUMAN)
RRWKLQVLDLRKNSHQDFWTVWSG

SEQ ID NO: 346917 - protein, 25 aa, Homo sapiens
  Native (PRAME_HUMAN)
RRWKLQVLDLRKNSHQDFWTVWSGN

SEQ ID NO: 346918 - protein, 13 aa, Homo sapiens
  Native (PRAME_HUMAN)
RWKLQVLDLRKNS

SEQ ID NO: 346919 - protein, 14 aa, Homo sapiens
  Native (PRAME_HUMAN)
RWKLQVLDLRKNSH

SEQ ID NO: 346920 - protein, 15 aa, Homo sapiens
  Native (PRAME_HUMAN)
RWKLQVLDLRKNSHQ

SEQ ID NO: 346921 - protein, 16 aa, Homo sapiens
  Native (PRAME_HUMAN)
RWKLQVLDLRKNSHQD

SEQ ID NO: 346922 - protein, 17 aa, Homo sapiens
  Native (PRAME_HUMAN)
RWKLQVLDLRKNSHQDF

SEQ ID NO: 346923 - protein, 18 aa, Homo sapiens
  Native (PRAME_HUMAN)
RWKLQVLDLRKNSHQDFW

SEQ ID NO: 346924 - protein, 19 aa, Homo sapiens
  Native (PRAME_HUMAN)
RWKLQVLDLRKNSHQDFWT

SEQ ID NO: 346925 - protein, 20 aa, Homo sapiens
  Native (PRAME_HUMAN)
RWKLQVLDLRKNSHQDFWTV

SEQ ID NO: 346926 - protein, 21 aa, Homo sapiens
  Native (PRAME_HUMAN)
RWKLQVLDLRKNSHQDFWTVW

SEQ ID NO: 346927 - protein, 22 aa, Homo sapiens
  Native (PRAME_HUMAN)
RWKLQVLDLRKNSHQDFWTVWS

SEQ ID NO: 346928 - protein, 23 aa, Homo sapiens
  Native (PRAME_HUMAN)
RWKLQVLDLRKNSHQDFWTVWSG

SEQ ID NO: 346929 - protein, 24 aa, Homo sapiens
  Native (PRAME_HUMAN)
RWKLQVLDLRKNSHQDFWTVWSGN

SEQ ID NO: 346930 - protein, 25 aa, Homo sapiens
  Native (PRAME_HUMAN)
RWKLQVLDLRKNSHQDFWTVWSGNR

SEQ ID NO: 346931 - protein, 13 aa, Homo sapiens
  Native (PRAME_HUMAN)
RYISMSVWTSPRR

SEQ ID NO: 346932 - protein, 14 aa, Homo sapiens
  Native (PRAME_HUMAN)
RYISMSVWTSPRRL

SEQ ID NO: 346933 - protein, 15 aa, Homo sapiens
  Native (PRAME_HUMAN)
RYISMSVWTSPRRLV

SEQ ID NO: 346934 - protein, 16 aa, Homo sapiens
  Native (PRAME_HUMAN)
RYISMSVWTSPRRLVE

SEQ ID NO: 346935 - protein, 17 aa, Homo sapiens
  Native (PRAME_HUMAN)
RYISMSVWTSPRRLVEL

SEQ ID NO: 346936 - protein, 18 aa, Homo sapiens
  Native (PRAME_HUMAN)
RYISMSVWTSPRRLVELA

SEQ ID NO: 346937 - protein, 19 aa, Homo sapiens
  Native (PRAME_HUMAN)
RYISMSVWTSPRRLVELAG

SEQ ID NO: 346938 - protein, 20 aa, Homo sapiens
  Native (PRAME_HUMAN)
RYISMSVWTSPRRLVELAGQ

SEQ ID NO: 346939 - protein, 21 aa, Homo sapiens
  Native (PRAME_HUMAN)
RYISMSVWTSPRRLVELAGQS

SEQ ID NO: 346940 - protein, 22 aa, Homo sapiens
  Native (PRAME_HUMAN)
RYISMSVWTSPRRLVELAGQSL

SEQ ID NO: 346941 - protein, 23 aa, Homo sapiens
  Native (PRAME_HUMAN)
RYISMSVWTSPRRLVELAGQSLL

SEQ ID NO: 346942 - protein, 24 aa, Homo sapiens
  Native (PRAME_HUMAN)
RYISMSVWTSPRRLVELAGQSLLK

SEQ ID NO: 346943 - protein, 25 aa, Homo sapiens
  Native (PRAME_HUMAN)
RYISMSVWTSPRRLVELAGQSLLKD

SEQ ID NO: 346944 - protein, 13 aa, Homo sapiens
  Native (PRAME_HUMAN)
SALQSLLQHLIGL

SEQ ID NO: 346945 - protein, 14 aa, Homo sapiens
  Native (PRAME_HUMAN)
SALQSLLQHLIGLS

SEQ ID NO: 346946 - protein, 15 aa, Homo sapiens
  Native (PRAME_HUMAN)
SALQSLLQHLIGLSN

SEQ ID NO: 346947 - protein, 16 aa, Homo sapiens
  Native (PRAME_HUMAN)
SALQSLLQHLIGLSNL

SEQ ID NO: 346948 - protein, 17 aa, Homo sapiens
  Native (PRAME_HUMAN)
SALQSLLQHLIGLSNLT

SEQ ID NO: 346949 - protein, 18 aa, Homo sapiens
  Native (PRAME_HUMAN)
SALQSLLQHLIGLSNLTH

SEQ ID NO: 346950 - protein, 19 aa, Homo sapiens
  Native (PRAME_HUMAN)
SALQSLLQHLIGLSNLTHV

SEQ ID NO: 346951 - protein, 20 aa, Homo sapiens
  Native (PRAME_HUMAN)
SALQSLLQHLIGLSNLTHVL

SEQ ID NO: 346952 - protein, 21 aa, Homo sapiens
  Native (PRAME_HUMAN)
SALQSLLQHLIGLSNLTHVLY

SEQ ID NO: 346953 - protein, 22 aa, Homo sapiens
  Native (PRAME_HUMAN)
SALQSLLQHLIGLSNLTHVLYP

SEQ ID NO: 346954 - protein, 23 aa, Homo sapiens
  Native (PRAME_HUMAN)
SALQSLLQHLIGLSNLTHVLYPV

SEQ ID NO: 346955 - protein, 24 aa, Homo sapiens
  Native (PRAME_HUMAN)
SALQSLLQHLIGLSNLTHVLYPVP

SEQ ID NO: 346956 - protein, 25 aa, Homo sapiens
  Native (PRAME_HUMAN)
SALQSLLQHLIGLSNLTHVLYPVPL

SEQ ID NO: 346957 - protein, 15 aa, Homo sapiens
  Native (PRAME_HUMAN)
SATLQDLVFDECGIT

SEQ ID NO: 346958 - protein, 16 aa, Homo sapiens
  Native (PRAME_HUMAN)
SATLQDLVFDECGITD

SEQ ID NO: 346959 - protein, 20 aa, Homo sapiens
  Native (PRAME_HUMAN)
SATLQDLVFDECGITDDQLL

SEQ ID NO: 346960 - protein, 22 aa, Homo sapiens
  Native (PRAME_HUMAN)
SATLQDLVFDECGITDDQLLAL

SEQ ID NO: 346961 - protein, 23 aa, Homo sapiens
  Native (PRAME_HUMAN)
SATLQDLVFDECGITDDQLLALL

SEQ ID NO: 346962 - protein, 24 aa, Homo sapiens
  Native (PRAME_HUMAN)
SATLQDLVFDECGITDDQLLALLP

SEQ ID NO: 346963 - protein, 25 aa, Homo sapiens
  Native (PRAME_HUMAN)
SATLQDLVFDECGITDDQLLALLPS

SEQ ID NO: 346964 - protein, 15 aa, Homo sapiens
  Native (PRAME_HUMAN)
SEGDVMHLSQSPSVS

SEQ ID NO: 346965 - protein, 16 aa, Homo sapiens
  Native (PRAME_HUMAN)
SEGDVMHLSQSPSVSQ

SEQ ID NO: 346966 - protein, 17 aa, Homo sapiens
  Native (PRAME_HUMAN)
SEGDVMHLSQSPSVSQL

SEQ ID NO: 346967 - protein, 19 aa, Homo sapiens
  Native (PRAME_HUMAN)
SEGDVMHLSQSPSVSQLSV

SEQ ID NO: 346968 - protein, 20 aa, Homo sapiens
  Native (PRAME_HUMAN)
SEGDVMHLSQSPSVSQLSVL

SEQ ID NO: 346969 - protein, 21 aa, Homo sapiens
  Native (PRAME_HUMAN)
SEGDVMHLSQSPSVSQLSVLS

SEQ ID NO: 346970 - protein, 22 aa, Homo sapiens
  Native (PRAME_HUMAN)
SEGDVMHLSQSPSVSQLSVLSL

SEQ ID NO: 346971 - protein, 23 aa, Homo sapiens
  Native (PRAME_HUMAN)
SEGDVMHLSQSPSVSQLSVLSLS

SEQ ID NO: 346972 - protein, 24 aa, Homo sapiens
  Native (PRAME_HUMAN)
SEGDVMHLSQSPSVSQLSVLSLSG

SEQ ID NO: 346973 - protein, 25 aa, Homo sapiens
  Native (PRAME_HUMAN)
SEGDVMHLSQSPSVSQLSVLSLSGV

SEQ ID NO: 346974 - protein, 14 aa, Homo sapiens
  Native (PRAME_HUMAN)
SFPEPEAAQPMTKK

SEQ ID NO: 346975 - protein, 15 aa, Homo sapiens
  Native (PRAME_HUMAN)
SFPEPEAAQPMTKKR

SEQ ID NO: 346976 - protein, 16 aa, Homo sapiens
  Native (PRAME_HUMAN)
SFPEPEAAQPMTKKRK

SEQ ID NO: 346977 - protein, 17 aa, Homo sapiens
  Native (PRAME_HUMAN)
SFPEPEAAQPMTKKRKV

SEQ ID NO: 346978 - protein, 20 aa, Homo sapiens
  Native (PRAME_HUMAN)
SFPEPEAAQPMTKKRKVDGL

SEQ ID NO: 346979 - protein, 24 aa, Homo sapiens
  Native (PRAME_HUMAN)
SFPEPEAAQPMTKKRKVDGLSTEA

SEQ ID NO: 346980 - protein, 25 aa, Homo sapiens
  Native (PRAME_HUMAN)
SFPEPEAAQPMTKKRKVDGLSTEAE

SEQ ID NO: 346981 - protein, 13 aa, Homo sapiens
  Native (PRAME_HUMAN)
SFYGNSISISALQ

SEQ ID NO: 346982 - protein, 14 aa, Homo sapiens
  Native (PRAME_HUMAN)
SFYGNSISISALQS

SEQ ID NO: 346983 - protein, 15 aa, Homo sapiens
  Native (PRAME_HUMAN)
SFYGNSISISALQSL

SEQ ID NO: 346984 - protein, 16 aa, Homo sapiens
  Native (PRAME_HUMAN)
SFYGNSISISALQSLL

SEQ ID NO: 346985 - protein, 17 aa, Homo sapiens
  Native (PRAME_HUMAN)
SFYGNSISISALQSLLQ

SEQ ID NO: 346986 - protein, 18 aa, Homo sapiens
  Native (PRAME_HUMAN)
SFYGNSISISALQSLLQH

SEQ ID NO: 346987 - protein, 19 aa, Homo sapiens
  Native (PRAME_HUMAN)
SFYGNSISISALQSLLQHL

SEQ ID NO: 346988 - protein, 20 aa, Homo sapiens
  Native (PRAME_HUMAN)
SFYGNSISISALQSLLQHLI

SEQ ID NO: 346989 - protein, 21 aa, Homo sapiens
  Native (PRAME_HUMAN)
SFYGNSISISALQSLLQHLIG

SEQ ID NO: 346990 - protein, 22 aa, Homo sapiens
  Native (PRAME_HUMAN)
SFYGNSISISALQSLLQHLIGL

SEQ ID NO: 346991 - protein, 23 aa, Homo sapiens
  Native (PRAME_HUMAN)
SFYGNSISISALQSLLQHLIGLS

SEQ ID NO: 346992 - protein, 24 aa, Homo sapiens
  Native (PRAME_HUMAN)
SFYGNSISISALQSLLQHLIGLSN

SEQ ID NO: 346993 - protein, 25 aa, Homo sapiens
  Native (PRAME_HUMAN)
SFYGNSISISALQSLLQHLIGLSNL

SEQ ID NO: 346994 - protein, 15 aa, Homo sapiens
  Native (PRAME_HUMAN)
SGNRASLYSFPEPEA

SEQ ID NO: 346995 - protein, 16 aa, Homo sapiens
  Native (PRAME_HUMAN)
SGNRASLYSFPEPEAA

SEQ ID NO: 346996 - protein, 17 aa, Homo sapiens
  Native (PRAME_HUMAN)
SGNRASLYSFPEPEAAQ

SEQ ID NO: 346997 - protein, 19 aa, Homo sapiens
  Native (PRAME_HUMAN)
SGNRASLYSFPEPEAAQPM

SEQ ID NO: 346998 - protein, 20 aa, Homo sapiens
  Native (PRAME_HUMAN)
SGNRASLYSFPEPEAAQPMT

SEQ ID NO: 346999 - protein, 21 aa, Homo sapiens
  Native (PRAME_HUMAN)
SGNRASLYSFPEPEAAQPMTK

SEQ ID NO: 347000 - protein, 22 aa, Homo sapiens
  Native (PRAME_HUMAN)
SGNRASLYSFPEPEAAQPMTKK

SEQ ID NO: 347001 - protein, 23 aa, Homo sapiens
  Native (PRAME_HUMAN)
SGNRASLYSFPEPEAAQPMTKKR

SEQ ID NO: 347002 - protein, 24 aa, Homo sapiens
  Native (PRAME_HUMAN)
SGNRASLYSFPEPEAAQPMTKKRK

SEQ ID NO: 347003 - protein, 25 aa, Homo sapiens
  Native (PRAME_HUMAN)
SGNRASLYSFPEPEAAQPMTKKRKV

SEQ ID NO: 347004 - protein, 13 aa, Homo sapiens
  Native (PRAME_HUMAN)
SGVMLTDVSPEPL

SEQ ID NO: 347005 - protein, 14 aa, Homo sapiens
  Native (PRAME_HUMAN)
SGVMLTDVSPEPLQ

SEQ ID NO: 347006 - protein, 15 aa, Homo sapiens
  Native (PRAME_HUMAN)
SGVMLTDVSPEPLQA

SEQ ID NO: 347007 - protein, 16 aa, Homo sapiens
  Native (PRAME_HUMAN)
SGVMLTDVSPEPLQAL

SEQ ID NO: 347008 - protein, 17 aa, Homo sapiens
  Native (PRAME_HUMAN)
SGVMLTDVSPEPLQALL

SEQ ID NO: 347009 - protein, 18 aa, Homo sapiens
  Native (PRAME_HUMAN)
SGVMLTDVSPEPLQALLE

SEQ ID NO: 347010 - protein, 19 aa, Homo sapiens
  Native (PRAME_HUMAN)
SGVMLTDVSPEPLQALLER

SEQ ID NO: 347011 - protein, 20 aa, Homo sapiens
  Native (PRAME_HUMAN)
SGVMLTDVSPEPLQALLERA

SEQ ID NO: 347012 - protein, 21 aa, Homo sapiens
  Native (PRAME_HUMAN)
SGVMLTDVSPEPLQALLERAS

SEQ ID NO: 347013 - protein, 22 aa, Homo sapiens
  Native (PRAME_HUMAN)
SGVMLTDVSPEPLQALLERASA

SEQ ID NO: 347014 - protein, 23 aa, Homo sapiens
  Native (PRAME_HUMAN)
SGVMLTDVSPEPLQALLERASAT

SEQ ID NO: 347015 - protein, 24 aa, Homo sapiens
  Native (PRAME_HUMAN)
SGVMLTDVSPEPLQALLERASATL

SEQ ID NO: 347016 - protein, 25 aa, Homo sapiens
  Native (PRAME_HUMAN)
SGVMLTDVSPEPLQALLERASATLQ

SEQ ID NO: 347017 - protein, 14 aa, Homo sapiens
  Native (PRAME_HUMAN)
SHCSQLTTLSFYGN

SEQ ID NO: 347018 - protein, 15 aa, Homo sapiens
  Native (PRAME_HUMAN)
SHCSQLTTLSFYGNS

SEQ ID NO: 347019 - protein, 16 aa, Homo sapiens
  Native (PRAME_HUMAN)
SHCSQLTTLSFYGNSI

SEQ ID NO: 347020 - protein, 17 aa, Homo sapiens
  Native (PRAME_HUMAN)
SHCSQLTTLSFYGNSIS

SEQ ID NO: 347021 - protein, 18 aa, Homo sapiens
  Native (PRAME_HUMAN)
SHCSQLTTLSFYGNSISI

SEQ ID NO: 347022 - protein, 19 aa, Homo sapiens
  Native (PRAME_HUMAN)
SHCSQLTTLSFYGNSISIS

SEQ ID NO: 347023 - protein, 20 aa, Homo sapiens
  Native (PRAME_HUMAN)
SHCSQLTTLSFYGNSISISA

SEQ ID NO: 347024 - protein, 21 aa, Homo sapiens
  Native (PRAME_HUMAN)
SHCSQLTTLSFYGNSISISAL

SEQ ID NO: 347025 - protein, 22 aa, Homo sapiens
  Native (PRAME_HUMAN)
SHCSQLTTLSFYGNSISISALQ

SEQ ID NO: 347026 - protein, 23 aa, Homo sapiens
  Native (PRAME_HUMAN)
SHCSQLTTLSFYGNSISISALQS

SEQ ID NO: 347027 - protein, 24 aa, Homo sapiens
  Native (PRAME_HUMAN)
SHCSQLTTLSFYGNSISISALQSL

SEQ ID NO: 347028 - protein, 25 aa, Homo sapiens
  Native (PRAME_HUMAN)
SHCSQLTTLSFYGNSISISALQSLL

SEQ ID NO: 347029 - protein, 14 aa, Homo sapiens
  Native (PRAME_HUMAN)
SHIHASSYISPEKE

SEQ ID NO: 347030 - protein, 15 aa, Homo sapiens
  Native (PRAME_HUMAN)
SHIHASSYISPEKEE

SEQ ID NO: 347031 - protein, 16 aa, Homo sapiens
  Native (PRAME_HUMAN)
SHIHASSYISPEKEEQ

SEQ ID NO: 347032 - protein, 17 aa, Homo sapiens
  Native (PRAME_HUMAN)
SHIHASSYISPEKEEQY

SEQ ID NO: 347033 - protein, 20 aa, Homo sapiens
  Native (PRAME_HUMAN)
SHIHASSYISPEKEEQYIAQ

SEQ ID NO: 347034 - protein, 22 aa, Homo sapiens
  Native (PRAME_HUMAN)
SHIHASSYISPEKEEQYIAQFT

SEQ ID NO: 347035 - protein, 23 aa, Homo sapiens
  Native (PRAME_HUMAN)
SHIHASSYISPEKEEQYIAQFTS

SEQ ID NO: 347036 - protein, 24 aa, Homo sapiens
  Native (PRAME_HUMAN)
SHIHASSYISPEKEEQYIAQFTSQ

SEQ ID NO: 347037 - protein, 25 aa, Homo sapiens
  Native (PRAME_HUMAN)
SHIHASSYISPEKEEQYIAQFTSQF

SEQ ID NO: 347038 - protein, 14 aa, Homo sapiens
  Native (PRAME_HUMAN)
SHQDFWTVWSGNRA

SEQ ID NO: 347039 - protein, 15 aa, Homo sapiens
  Native (PRAME_HUMAN)
SHQDFWTVWSGNRAS

SEQ ID NO: 347040 - protein, 16 aa, Homo sapiens
  Native (PRAME_HUMAN)
SHQDFWTVWSGNRASL

SEQ ID NO: 347041 - protein, 17 aa, Homo sapiens
  Native (PRAME_HUMAN)
SHQDFWTVWSGNRASLY

SEQ ID NO: 347042 - protein, 18 aa, Homo sapiens
  Native (PRAME_HUMAN)
SHQDFWTVWSGNRASLYS

SEQ ID NO: 347043 - protein, 19 aa, Homo sapiens
  Native (PRAME_HUMAN)
SHQDFWTVWSGNRASLYSF

SEQ ID NO: 347044 - protein, 20 aa, Homo sapiens
  Native (PRAME_HUMAN)
SHQDFWTVWSGNRASLYSFP

SEQ ID NO: 347045 - protein, 21 aa, Homo sapiens
  Native (PRAME_HUMAN)
SHQDFWTVWSGNRASLYSFPE

SEQ ID NO: 347046 - protein, 22 aa, Homo sapiens
  Native (PRAME_HUMAN)
SHQDFWTVWSGNRASLYSFPEP

SEQ ID NO: 347047 - protein, 23 aa, Homo sapiens
  Native (PRAME_HUMAN)
SHQDFWTVWSGNRASLYSFPEPE

SEQ ID NO: 347048 - protein, 24 aa, Homo sapiens
  Native (PRAME_HUMAN)
SHQDFWTVWSGNRASLYSFPEPEA

SEQ ID NO: 347049 - protein, 25 aa, Homo sapiens
  Native (PRAME_HUMAN)
SHQDFWTVWSGNRASLYSFPEPEAA

SEQ ID NO: 347050 - protein, 14 aa, Homo sapiens
  Native (PRAME_HUMAN)
SIEDLEVTCTWKLP

SEQ ID NO: 347051 - protein, 15 aa, Homo sapiens
  Native (PRAME_HUMAN)
SIEDLEVTCTWKLPT

SEQ ID NO: 347052 - protein, 16 aa, Homo sapiens
  Native (PRAME_HUMAN)
SIEDLEVTCTWKLPTL

SEQ ID NO: 347053 - protein, 17 aa, Homo sapiens
  Native (PRAME_HUMAN)
SIEDLEVTCTWKLPTLA

SEQ ID NO: 347054 - protein, 18 aa, Homo sapiens
  Native (PRAME_HUMAN)
SIEDLEVTCTWKLPTLAK

SEQ ID NO: 347055 - protein, 19 aa, Homo sapiens
  Native (PRAME_HUMAN)
SIEDLEVTCTWKLPTLAKF

SEQ ID NO: 347056 - protein, 20 aa, Homo sapiens
  Native (PRAME_HUMAN)
SIEDLEVTCTWKLPTLAKFS

SEQ ID NO: 347057 - protein, 21 aa, Homo sapiens
  Native (PRAME_HUMAN)
SIEDLEVTCTWKLPTLAKFSP

SEQ ID NO: 347058 - protein, 22 aa, Homo sapiens
  Native (PRAME_HUMAN)
SIEDLEVTCTWKLPTLAKFSPY

SEQ ID NO: 347059 - protein, 23 aa, Homo sapiens
  Native (PRAME_HUMAN)
SIEDLEVTCTWKLPTLAKFSPYL

SEQ ID NO: 347060 - protein, 24 aa, Homo sapiens
  Native (PRAME_HUMAN)
SIEDLEVTCTWKLPTLAKFSPYLG

SEQ ID NO: 347061 - protein, 25 aa, Homo sapiens
  Native (PRAME_HUMAN)
SIEDLEVTCTWKLPTLAKFSPYLGQ

SEQ ID NO: 347062 - protein, 13 aa, Homo sapiens
  Native (PRAME_HUMAN)
SIQSRYISMSVWT

SEQ ID NO: 347063 - protein, 14 aa, Homo sapiens
  Native (PRAME_HUMAN)
SIQSRYISMSVWTS

SEQ ID NO: 347064 - protein, 15 aa, Homo sapiens
  Native (PRAME_HUMAN)
SIQSRYISMSVWTSP

SEQ ID NO: 347065 - protein, 16 aa, Homo sapiens
  Native (PRAME_HUMAN)
SIQSRYISMSVWTSPR

SEQ ID NO: 347066 - protein, 17 aa, Homo sapiens
  Native (PRAME_HUMAN)
SIQSRYISMSVWTSPRR

SEQ ID NO: 347067 - protein, 18 aa, Homo sapiens
  Native (PRAME_HUMAN)
SIQSRYISMSVWTSPRRL

SEQ ID NO: 347068 - protein, 19 aa, Homo sapiens
  Native (PRAME_HUMAN)
SIQSRYISMSVWTSPRRLV

SEQ ID NO: 347069 - protein, 20 aa, Homo sapiens
  Native (PRAME_HUMAN)
SIQSRYISMSVWTSPRRLVE

SEQ ID NO: 347070 - protein, 21 aa, Homo sapiens
  Native (PRAME_HUMAN)
SIQSRYISMSVWTSPRRLVEL

SEQ ID NO: 347071 - protein, 22 aa, Homo sapiens
  Native (PRAME_HUMAN)
SIQSRYISMSVWTSPRRLVELA

SEQ ID NO: 347072 - protein, 23 aa, Homo sapiens
  Native (PRAME_HUMAN)
SIQSRYISMSVWTSPRRLVELAG

SEQ ID NO: 347073 - protein, 24 aa, Homo sapiens
  Native (PRAME_HUMAN)
SIQSRYISMSVWTSPRRLVELAGQ

SEQ ID NO: 347074 - protein, 25 aa, Homo sapiens
  Native (PRAME_HUMAN)
SIQSRYISMSVWTSPRRLVELAGQS

SEQ ID NO: 347075 - protein, 13 aa, Homo sapiens
  Native (PRAME_HUMAN)
SISALQSLLQHLI

SEQ ID NO: 347076 - protein, 14 aa, Homo sapiens
  Native (PRAME_HUMAN)
SISALQSLLQHLIG

SEQ ID NO: 347077 - protein, 15 aa, Homo sapiens
  Native (PRAME_HUMAN)
SISALQSLLQHLIGL

SEQ ID NO: 347078 - protein, 16 aa, Homo sapiens
  Native (PRAME_HUMAN)
SISALQSLLQHLIGLS

SEQ ID NO: 347079 - protein, 17 aa, Homo sapiens
  Native (PRAME_HUMAN)
SISALQSLLQHLIGLSN

SEQ ID NO: 347080 - protein, 18 aa, Homo sapiens
  Native (PRAME_HUMAN)
SISALQSLLQHLIGLSNL

SEQ ID NO: 347081 - protein, 19 aa, Homo sapiens
  Native (PRAME_HUMAN)
SISALQSLLQHLIGLSNLT

SEQ ID NO: 347082 - protein, 20 aa, Homo sapiens
  Native (PRAME_HUMAN)
SISALQSLLQHLIGLSNLTH

SEQ ID NO: 347083 - protein, 21 aa, Homo sapiens
  Native (PRAME_HUMAN)
SISALQSLLQHLIGLSNLTHV

SEQ ID NO: 347084 - protein, 22 aa, Homo sapiens
  Native (PRAME_HUMAN)
SISALQSLLQHLIGLSNLTHVL

SEQ ID NO: 347085 - protein, 23 aa, Homo sapiens
  Native (PRAME_HUMAN)
SISALQSLLQHLIGLSNLTHVLY

SEQ ID NO: 347086 - protein, 24 aa, Homo sapiens
  Native (PRAME_HUMAN)
SISALQSLLQHLIGLSNLTHVLYP

SEQ ID NO: 347087 - protein, 25 aa, Homo sapiens
  Native (PRAME_HUMAN)
SISALQSLLQHLIGLSNLTHVLYPV

SEQ ID NO: 347088 - protein, 13 aa, Homo sapiens
  Native (PRAME_HUMAN)
SISISALQSLLQH

SEQ ID NO: 347089 - protein, 14 aa, Homo sapiens
  Native (PRAME_HUMAN)
SISISALQSLLQHL

SEQ ID NO: 347090 - protein, 16 aa, Homo sapiens
  Native (PRAME_HUMAN)
SISISALQSLLQHLIG

SEQ ID NO: 347091 - protein, 17 aa, Homo sapiens
  Native (PRAME_HUMAN)
SISISALQSLLQHLIGL

SEQ ID NO: 347092 - protein, 18 aa, Homo sapiens
  Native (PRAME_HUMAN)
SISISALQSLLQHLIGLS

SEQ ID NO: 347093 - protein, 19 aa, Homo sapiens
  Native (PRAME_HUMAN)
SISISALQSLLQHLIGLSN

SEQ ID NO: 347094 - protein, 20 aa, Homo sapiens
  Native (PRAME_HUMAN)
SISISALQSLLQHLIGLSNL

SEQ ID NO: 347095 - protein, 21 aa, Homo sapiens
  Native (PRAME_HUMAN)
SISISALQSLLQHLIGLSNLT

SEQ ID NO: 347096 - protein, 22 aa, Homo sapiens
  Native (PRAME_HUMAN)
SISISALQSLLQHLIGLSNLTH

SEQ ID NO: 347097 - protein, 23 aa, Homo sapiens
  Native (PRAME_HUMAN)
SISISALQSLLQHLIGLSNLTHV

SEQ ID NO: 347098 - protein, 24 aa, Homo sapiens
  Native (PRAME_HUMAN)
SISISALQSLLQHLIGLSNLTHVL

SEQ ID NO: 347099 - protein, 25 aa, Homo sapiens
  Native (PRAME_HUMAN)
SISISALQSLLQHLIGLSNLTHVLY

SEQ ID NO: 347100 - protein, 15 aa, Homo sapiens
  Native (PRAME_HUMAN)
SITNCRLSEGDVMHL

SEQ ID NO: 347101 - protein, 20 aa, Homo sapiens
  Native (PRAME_HUMAN)
SITNCRLSEGDVMHLSQSPS

SEQ ID NO: 347102 - protein, 21 aa, Homo sapiens
  Native (PRAME_HUMAN)
SITNCRLSEGDVMHLSQSPSV

SEQ ID NO: 347103 - protein, 22 aa, Homo sapiens
  Native (PRAME_HUMAN)
SITNCRLSEGDVMHLSQSPSVS

SEQ ID NO: 347104 - protein, 23 aa, Homo sapiens
  Native (PRAME_HUMAN)
SITNCRLSEGDVMHLSQSPSVSQ

SEQ ID NO: 347105 - protein, 24 aa, Homo sapiens
  Native (PRAME_HUMAN)
SITNCRLSEGDVMHLSQSPSVSQL

SEQ ID NO: 347106 - protein, 25 aa, Homo sapiens
  Native (PRAME_HUMAN)
SITNCRLSEGDVMHLSQSPSVSQLS

SEQ ID NO: 347107 - protein, 13 aa, Homo sapiens
  Native (PRAME_HUMAN)
SLFFLRGRLDQLL

SEQ ID NO: 347108 - protein, 14 aa, Homo sapiens
  Native (PRAME_HUMAN)
SLFFLRGRLDQLLR

SEQ ID NO: 347109 - protein, 15 aa, Homo sapiens
  Native (PRAME_HUMAN)
SLFFLRGRLDQLLRH

SEQ ID NO: 347110 - protein, 16 aa, Homo sapiens
  Native (PRAME_HUMAN)
SLFFLRGRLDQLLRHV

SEQ ID NO: 347111 - protein, 17 aa, Homo sapiens
  Native (PRAME_HUMAN)
SLFFLRGRLDQLLRHVM

SEQ ID NO: 347112 - protein, 18 aa, Homo sapiens
  Native (PRAME_HUMAN)
SLFFLRGRLDQLLRHVMN

SEQ ID NO: 347113 - protein, 19 aa, Homo sapiens
  Native (PRAME_HUMAN)
SLFFLRGRLDQLLRHVMNP

SEQ ID NO: 347114 - protein, 20 aa, Homo sapiens
  Native (PRAME_HUMAN)
SLFFLRGRLDQLLRHVMNPL

SEQ ID NO: 347115 - protein, 21 aa, Homo sapiens
  Native (PRAME_HUMAN)
SLFFLRGRLDQLLRHVMNPLE

SEQ ID NO: 347116 - protein, 22 aa, Homo sapiens
  Native (PRAME_HUMAN)
SLFFLRGRLDQLLRHVMNPLET

SEQ ID NO: 347117 - protein, 23 aa, Homo sapiens
  Native (PRAME_HUMAN)
SLFFLRGRLDQLLRHVMNPLETL

SEQ ID NO: 347118 - protein, 24 aa, Homo sapiens
  Native (PRAME_HUMAN)
SLFFLRGRLDQLLRHVMNPLETLS

SEQ ID NO: 347119 - protein, 25 aa, Homo sapiens
  Native (PRAME_HUMAN)
SLFFLRGRLDQLLRHVMNPLETLSI

SEQ ID NO: 347120 - protein, 13 aa, Homo sapiens
  Native (PRAME_HUMAN)
SLLKDEALAIAAL

SEQ ID NO: 347121 - protein, 14 aa, Homo sapiens
  Native (PRAME_HUMAN)
SLLKDEALAIAALE

SEQ ID NO: 347122 - protein, 15 aa, Homo sapiens
  Native (PRAME_HUMAN)
SLLKDEALAIAALEL

SEQ ID NO: 347123 - protein, 16 aa, Homo sapiens
  Native (PRAME_HUMAN)
SLLKDEALAIAALELL

SEQ ID NO: 347124 - protein, 17 aa, Homo sapiens
  Native (PRAME_HUMAN)
SLLKDEALAIAALELLP

SEQ ID NO: 347125 - protein, 18 aa, Homo sapiens
  Native (PRAME_HUMAN)
SLLKDEALAIAALELLPR

SEQ ID NO: 347126 - protein, 19 aa, Homo sapiens
  Native (PRAME_HUMAN)
SLLKDEALAIAALELLPRE

SEQ ID NO: 347127 - protein, 20 aa, Homo sapiens
  Native (PRAME_HUMAN)
SLLKDEALAIAALELLPREL

SEQ ID NO: 347128 - protein, 21 aa, Homo sapiens
  Native (PRAME_HUMAN)
SLLKDEALAIAALELLPRELF

SEQ ID NO: 347129 - protein, 22 aa, Homo sapiens
  Native (PRAME_HUMAN)
SLLKDEALAIAALELLPRELFP

SEQ ID NO: 347130 - protein, 23 aa, Homo sapiens
  Native (PRAME_HUMAN)
SLLKDEALAIAALELLPRELFPP

SEQ ID NO: 347131 - protein, 24 aa, Homo sapiens
  Native (PRAME_HUMAN)
SLLKDEALAIAALELLPRELFPPL

SEQ ID NO: 347132 - protein, 25 aa, Homo sapiens
  Native (PRAME_HUMAN)
SLLKDEALAIAALELLPRELFPPLF

SEQ ID NO: 347133 - protein, 13 aa, Homo sapiens
  Native (PRAME_HUMAN)
SLLQHLIGLSNLT

SEQ ID NO: 347134 - protein, 14 aa, Homo sapiens
  Native (PRAME_HUMAN)
SLLQHLIGLSNLTH

SEQ ID NO: 347135 - protein, 15 aa, Homo sapiens
  Native (PRAME_HUMAN)
SLLQHLIGLSNLTHV

SEQ ID NO: 347136 - protein, 16 aa, Homo sapiens
  Native (PRAME_HUMAN)
SLLQHLIGLSNLTHVL

SEQ ID NO: 347137 - protein, 17 aa, Homo sapiens
  Native (PRAME_HUMAN)
SLLQHLIGLSNLTHVLY

SEQ ID NO: 347138 - protein, 18 aa, Homo sapiens
  Native (PRAME_HUMAN)
SLLQHLIGLSNLTHVLYP

SEQ ID NO: 347139 - protein, 19 aa, Homo sapiens
  Native (PRAME_HUMAN)
SLLQHLIGLSNLTHVLYPV

SEQ ID NO: 347140 - protein, 20 aa, Homo sapiens
  Native (PRAME_HUMAN)
SLLQHLIGLSNLTHVLYPVP

SEQ ID NO: 347141 - protein, 21 aa, Homo sapiens
  Native (PRAME_HUMAN)
SLLQHLIGLSNLTHVLYPVPL

SEQ ID NO: 347142 - protein, 22 aa, Homo sapiens
  Native (PRAME_HUMAN)
SLLQHLIGLSNLTHVLYPVPLE

SEQ ID NO: 347143 - protein, 23 aa, Homo sapiens
  Native (PRAME_HUMAN)
SLLQHLIGLSNLTHVLYPVPLES

SEQ ID NO: 347144 - protein, 24 aa, Homo sapiens
  Native (PRAME_HUMAN)
SLLQHLIGLSNLTHVLYPVPLESY

SEQ ID NO: 347145 - protein, 25 aa, Homo sapiens
  Native (PRAME_HUMAN)
SLLQHLIGLSNLTHVLYPVPLESYE

SEQ ID NO: 347146 - protein, 13 aa, Homo sapiens
  Native (PRAME_HUMAN)
SLQCLQALYVDSL

SEQ ID NO: 347147 - protein, 14 aa, Homo sapiens
  Native (PRAME_HUMAN)
SLQCLQALYVDSLF

SEQ ID NO: 347148 - protein, 15 aa, Homo sapiens
  Native (PRAME_HUMAN)
SLQCLQALYVDSLFF

SEQ ID NO: 347149 - protein, 16 aa, Homo sapiens
  Native (PRAME_HUMAN)
SLQCLQALYVDSLFFL

SEQ ID NO: 347150 - protein, 17 aa, Homo sapiens
  Native (PRAME_HUMAN)
SLQCLQALYVDSLFFLR

SEQ ID NO: 347151 - protein, 18 aa, Homo sapiens
  Native (PRAME_HUMAN)
SLQCLQALYVDSLFFLRG

SEQ ID NO: 347152 - protein, 19 aa, Homo sapiens
  Native (PRAME_HUMAN)
SLQCLQALYVDSLFFLRGR

SEQ ID NO: 347153 - protein, 20 aa, Homo sapiens
  Native (PRAME_HUMAN)
SLQCLQALYVDSLFFLRGRL

SEQ ID NO: 347154 - protein, 21 aa, Homo sapiens
  Native (PRAME_HUMAN)
SLQCLQALYVDSLFFLRGRLD

SEQ ID NO: 347155 - protein, 22 aa, Homo sapiens
  Native (PRAME_HUMAN)
SLQCLQALYVDSLFFLRGRLDQ

SEQ ID NO: 347156 - protein, 23 aa, Homo sapiens
  Native (PRAME_HUMAN)
SLQCLQALYVDSLFFLRGRLDQL

SEQ ID NO: 347157 - protein, 24 aa, Homo sapiens
  Native (PRAME_HUMAN)
SLQCLQALYVDSLFFLRGRLDQLL

SEQ ID NO: 347158 - protein, 25 aa, Homo sapiens
  Native (PRAME_HUMAN)
SLQCLQALYVDSLFFLRGRLDQLLR

SEQ ID NO: 347159 - protein, 14 aa, Homo sapiens
  Native (PRAME_HUMAN)
SLSGVMLTDVSPEP

SEQ ID NO: 347160 - protein, 15 aa, Homo sapiens
  Native (PRAME_HUMAN)
SLSGVMLTDVSPEPL

SEQ ID NO: 347161 - protein, 16 aa, Homo sapiens
  Native (PRAME_HUMAN)
SLSGVMLTDVSPEPLQ

SEQ ID NO: 347162 - protein, 17 aa, Homo sapiens
  Native (PRAME_HUMAN)
SLSGVMLTDVSPEPLQA

SEQ ID NO: 347163 - protein, 18 aa, Homo sapiens
  Native (PRAME_HUMAN)
SLSGVMLTDVSPEPLQAL

SEQ ID NO: 347164 - protein, 19 aa, Homo sapiens
  Native (PRAME_HUMAN)
SLSGVMLTDVSPEPLQALL

SEQ ID NO: 347165 - protein, 20 aa, Homo sapiens
  Native (PRAME_HUMAN)
SLSGVMLTDVSPEPLQALLE

SEQ ID NO: 347166 - protein, 21 aa, Homo sapiens
  Native (PRAME_HUMAN)
SLSGVMLTDVSPEPLQALLER

SEQ ID NO: 347167 - protein, 22 aa, Homo sapiens
  Native (PRAME_HUMAN)
SLSGVMLTDVSPEPLQALLERA

SEQ ID NO: 347168 - protein, 23 aa, Homo sapiens
  Native (PRAME_HUMAN)
SLSGVMLTDVSPEPLQALLERAS

SEQ ID NO: 347169 - protein, 24 aa, Homo sapiens
  Native (PRAME_HUMAN)
SLSGVMLTDVSPEPLQALLERASA

SEQ ID NO: 347170 - protein, 25 aa, Homo sapiens
  Native (PRAME_HUMAN)
SLSGVMLTDVSPEPLQALLERASAT

SEQ ID NO: 347171 - protein, 15 aa, Homo sapiens
  Native (PRAME_HUMAN)
SLSHCSQLTTLSFYG

SEQ ID NO: 347172 - protein, 16 aa, Homo sapiens
  Native (PRAME_HUMAN)
SLSHCSQLTTLSFYGN

SEQ ID NO: 347173 - protein, 17 aa, Homo sapiens
  Native (PRAME_HUMAN)
SLSHCSQLTTLSFYGNS

SEQ ID NO: 347174 - protein, 18 aa, Homo sapiens
  Native (PRAME_HUMAN)
SLSHCSQLTTLSFYGNSI

SEQ ID NO: 347175 - protein, 19 aa, Homo sapiens
  Native (PRAME_HUMAN)
SLSHCSQLTTLSFYGNSIS

SEQ ID NO: 347176 - protein, 20 aa, Homo sapiens
  Native (PRAME_HUMAN)
SLSHCSQLTTLSFYGNSISI

SEQ ID NO: 347177 - protein, 21 aa, Homo sapiens
  Native (PRAME_HUMAN)
SLSHCSQLTTLSFYGNSISIS

SEQ ID NO: 347178 - protein, 22 aa, Homo sapiens
  Native (PRAME_HUMAN)
SLSHCSQLTTLSFYGNSISISA

SEQ ID NO: 347179 - protein, 23 aa, Homo sapiens
  Native (PRAME_HUMAN)
SLSHCSQLTTLSFYGNSISISAL

SEQ ID NO: 347180 - protein, 24 aa, Homo sapiens
  Native (PRAME_HUMAN)
SLSHCSQLTTLSFYGNSISISALQ

SEQ ID NO: 347181 - protein, 25 aa, Homo sapiens
  Native (PRAME_HUMAN)
SLSHCSQLTTLSFYGNSISISALQS

SEQ ID NO: 347182 - protein, 16 aa, Homo sapiens
  Native (PRAME_HUMAN)
SLYSFPEPEAAQPMTK

SEQ ID NO: 347183 - protein, 17 aa, Homo sapiens
  Native (PRAME_HUMAN)
SLYSFPEPEAAQPMTKK

SEQ ID NO: 347184 - protein, 19 aa, Homo sapiens
  Native (PRAME_HUMAN)
SLYSFPEPEAAQPMTKKRK

SEQ ID NO: 347185 - protein, 20 aa, Homo sapiens
  Native (PRAME_HUMAN)
SLYSFPEPEAAQPMTKKRKV

SEQ ID NO: 347186 - protein, 13 aa, Homo sapiens
  Native (PRAME_HUMAN)
SMSVWTSPRRLVE

SEQ ID NO: 347187 - protein, 14 aa, Homo sapiens
  Native (PRAME_HUMAN)
SMSVWTSPRRLVEL

SEQ ID NO: 347188 - protein, 15 aa, Homo sapiens
  Native (PRAME_HUMAN)
SMSVWTSPRRLVELA

SEQ ID NO: 347189 - protein, 16 aa, Homo sapiens
  Native (PRAME_HUMAN)
SMSVWTSPRRLVELAG

SEQ ID NO: 347190 - protein, 17 aa, Homo sapiens
  Native (PRAME_HUMAN)
SMSVWTSPRRLVELAGQ

SEQ ID NO: 347191 - protein, 18 aa, Homo sapiens
  Native (PRAME_HUMAN)
SMSVWTSPRRLVELAGQS

SEQ ID NO: 347192 - protein, 19 aa, Homo sapiens
  Native (PRAME_HUMAN)
SMSVWTSPRRLVELAGQSL

SEQ ID NO: 347193 - protein, 20 aa, Homo sapiens
  Native (PRAME_HUMAN)
SMSVWTSPRRLVELAGQSLL

SEQ ID NO: 347194 - protein, 21 aa, Homo sapiens
  Native (PRAME_HUMAN)
SMSVWTSPRRLVELAGQSLLK

SEQ ID NO: 347195 - protein, 22 aa, Homo sapiens
  Native (PRAME_HUMAN)
SMSVWTSPRRLVELAGQSLLKD

SEQ ID NO: 347196 - protein, 23 aa, Homo sapiens
  Native (PRAME_HUMAN)
SMSVWTSPRRLVELAGQSLLKDE

SEQ ID NO: 347197 - protein, 24 aa, Homo sapiens
  Native (PRAME_HUMAN)
SMSVWTSPRRLVELAGQSLLKDEA

SEQ ID NO: 347198 - protein, 25 aa, Homo sapiens
  Native (PRAME_HUMAN)
SMSVWTSPRRLVELAGQSLLKDEAL

SEQ ID NO: 347199 - protein, 13 aa, Homo sapiens
  Native (PRAME_HUMAN)
SMVWLSANPCPHC

SEQ ID NO: 347200 - protein, 14 aa, Homo sapiens
  Native (PRAME_HUMAN)
SMVWLSANPCPHCG

SEQ ID NO: 347201 - protein, 15 aa, Homo sapiens
  Native (PRAME_HUMAN)
SMVWLSANPCPHCGD

SEQ ID NO: 347202 - protein, 16 aa, Homo sapiens
  Native (PRAME_HUMAN)
SMVWLSANPCPHCGDR

SEQ ID NO: 347203 - protein, 17 aa, Homo sapiens
  Native (PRAME_HUMAN)
SMVWLSANPCPHCGDRT

SEQ ID NO: 347204 - protein, 19 aa, Homo sapiens
  Native (PRAME_HUMAN)
SMVWLSANPCPHCGDRTFY

SEQ ID NO: 347205 - protein, 20 aa, Homo sapiens
  Native (PRAME_HUMAN)
SMVWLSANPCPHCGDRTFYD

SEQ ID NO: 347206 - protein, 21 aa, Homo sapiens
  Native (PRAME_HUMAN)
SMVWLSANPCPHCGDRTFYDP

SEQ ID NO: 347207 - protein, 22 aa, Homo sapiens
  Native (PRAME_HUMAN)
SMVWLSANPCPHCGDRTFYDPE

SEQ ID NO: 347208 - protein, 23 aa, Homo sapiens
  Native (PRAME_HUMAN)
SMVWLSANPCPHCGDRTFYDPEP

SEQ ID NO: 347209 - protein, 24 aa, Homo sapiens
  Native (PRAME_HUMAN)
SMVWLSANPCPHCGDRTFYDPEPI

SEQ ID NO: 347210 - protein, 25 aa, Homo sapiens
  Native (PRAME_HUMAN)
SMVWLSANPCPHCGDRTFYDPEPIL

SEQ ID NO: 347211 - protein, 13 aa, Homo sapiens
  Native (PRAME_HUMAN)
SNLTHVLYPVPLE

SEQ ID NO: 347212 - protein, 14 aa, Homo sapiens
  Native (PRAME_HUMAN)
SNLTHVLYPVPLES

SEQ ID NO: 347213 - protein, 15 aa, Homo sapiens
  Native (PRAME_HUMAN)
SNLTHVLYPVPLESY

SEQ ID NO: 347214 - protein, 16 aa, Homo sapiens
  Native (PRAME_HUMAN)
SNLTHVLYPVPLESYE

SEQ ID NO: 347215 - protein, 17 aa, Homo sapiens
  Native (PRAME_HUMAN)
SNLTHVLYPVPLESYED

SEQ ID NO: 347216 - protein, 18 aa, Homo sapiens
  Native (PRAME_HUMAN)
SNLTHVLYPVPLESYEDI

SEQ ID NO: 347217 - protein, 19 aa, Homo sapiens
  Native (PRAME_HUMAN)
SNLTHVLYPVPLESYEDIH

SEQ ID NO: 347218 - protein, 20 aa, Homo sapiens
  Native (PRAME_HUMAN)
SNLTHVLYPVPLESYEDIHG

SEQ ID NO: 347219 - protein, 21 aa, Homo sapiens
  Native (PRAME_HUMAN)
SNLTHVLYPVPLESYEDIHGT

SEQ ID NO: 347220 - protein, 22 aa, Homo sapiens
  Native (PRAME_HUMAN)
SNLTHVLYPVPLESYEDIHGTL

SEQ ID NO: 347221 - protein, 23 aa, Homo sapiens
  Native (PRAME_HUMAN)
SNLTHVLYPVPLESYEDIHGTLH

SEQ ID NO: 347222 - protein, 24 aa, Homo sapiens
  Native (PRAME_HUMAN)
SNLTHVLYPVPLESYEDIHGTLHL

SEQ ID NO: 347223 - protein, 25 aa, Homo sapiens
  Native (PRAME_HUMAN)
SNLTHVLYPVPLESYEDIHGTLHLE

SEQ ID NO: 347224 - protein, 16 aa, Homo sapiens
  Native (PRAME_HUMAN)
SPEKEEQYIAQFTSQF

SEQ ID NO: 347225 - protein, 17 aa, Homo sapiens
  Native (PRAME_HUMAN)
SPEKEEQYIAQFTSQFL

SEQ ID NO: 347226 - protein, 18 aa, Homo sapiens
  Native (PRAME_HUMAN)
SPEKEEQYIAQFTSQFLS

SEQ ID NO: 347227 - protein, 19 aa, Homo sapiens
  Native (PRAME_HUMAN)
SPEKEEQYIAQFTSQFLSL

SEQ ID NO: 347228 - protein, 20 aa, Homo sapiens
  Native (PRAME_HUMAN)
SPEKEEQYIAQFTSQFLSLQ

SEQ ID NO: 347229 - protein, 21 aa, Homo sapiens
  Native (PRAME_HUMAN)
SPEKEEQYIAQFTSQFLSLQC

SEQ ID NO: 347230 - protein, 22 aa, Homo sapiens
  Native (PRAME_HUMAN)
SPEKEEQYIAQFTSQFLSLQCL

SEQ ID NO: 347231 - protein, 23 aa, Homo sapiens
  Native (PRAME_HUMAN)
SPEKEEQYIAQFTSQFLSLQCLQ

SEQ ID NO: 347232 - protein, 24 aa, Homo sapiens
  Native (PRAME_HUMAN)
SPEKEEQYIAQFTSQFLSLQCLQA

SEQ ID NO: 347233 - protein, 25 aa, Homo sapiens
  Native (PRAME_HUMAN)
SPEKEEQYIAQFTSQFLSLQCLQAL

SEQ ID NO: 347234 - protein, 15 aa, Homo sapiens
  Native (PRAME_HUMAN)
SPEPLQALLERASAT

SEQ ID NO: 347235 - protein, 16 aa, Homo sapiens
  Native (PRAME_HUMAN)
SPEPLQALLERASATL

SEQ ID NO: 347236 - protein, 17 aa, Homo sapiens
  Native (PRAME_HUMAN)
SPEPLQALLERASATLQ

SEQ ID NO: 347237 - protein, 19 aa, Homo sapiens
  Native (PRAME_HUMAN)
SPEPLQALLERASATLQDL

SEQ ID NO: 347238 - protein, 20 aa, Homo sapiens
  Native (PRAME_HUMAN)
SPEPLQALLERASATLQDLV

SEQ ID NO: 347239 - protein, 21 aa, Homo sapiens
  Native (PRAME_HUMAN)
SPEPLQALLERASATLQDLVF

SEQ ID NO: 347240 - protein, 22 aa, Homo sapiens
  Native (PRAME_HUMAN)
SPEPLQALLERASATLQDLVFD

SEQ ID NO: 347241 - protein, 23 aa, Homo sapiens
  Native (PRAME_HUMAN)
SPEPLQALLERASATLQDLVFDE

SEQ ID NO: 347242 - protein, 24 aa, Homo sapiens
  Native (PRAME_HUMAN)
SPEPLQALLERASATLQDLVFDEC

SEQ ID NO: 347243 - protein, 25 aa, Homo sapiens
  Native (PRAME_HUMAN)
SPEPLQALLERASATLQDLVFDECG

SEQ ID NO: 347244 - protein, 13 aa, Homo sapiens
  Native (PRAME_HUMAN)
SPRRLVELAGQSL

SEQ ID NO: 347245 - protein, 14 aa, Homo sapiens
  Native (PRAME_HUMAN)
SPRRLVELAGQSLL

SEQ ID NO: 347246 - protein, 15 aa, Homo sapiens
  Native (PRAME_HUMAN)
SPRRLVELAGQSLLK

SEQ ID NO: 347247 - protein, 16 aa, Homo sapiens
  Native (PRAME_HUMAN)
SPRRLVELAGQSLLKD

SEQ ID NO: 347248 - protein, 17 aa, Homo sapiens
  Native (PRAME_HUMAN)
SPRRLVELAGQSLLKDE

SEQ ID NO: 347249 - protein, 18 aa, Homo sapiens
  Native (PRAME_HUMAN)
SPRRLVELAGQSLLKDEA

SEQ ID NO: 347250 - protein, 19 aa, Homo sapiens
  Native (PRAME_HUMAN)
SPRRLVELAGQSLLKDEAL

SEQ ID NO: 347251 - protein, 20 aa, Homo sapiens
  Native (PRAME_HUMAN)
SPRRLVELAGQSLLKDEALA

SEQ ID NO: 347252 - protein, 21 aa, Homo sapiens
  Native (PRAME_HUMAN)
SPRRLVELAGQSLLKDEALAI

SEQ ID NO: 347253 - protein, 22 aa, Homo sapiens
  Native (PRAME_HUMAN)
SPRRLVELAGQSLLKDEALAIA

SEQ ID NO: 347254 - protein, 23 aa, Homo sapiens
  Native (PRAME_HUMAN)
SPRRLVELAGQSLLKDEALAIAA

SEQ ID NO: 347255 - protein, 24 aa, Homo sapiens
  Native (PRAME_HUMAN)
SPRRLVELAGQSLLKDEALAIAAL

SEQ ID NO: 347256 - protein, 25 aa, Homo sapiens
  Native (PRAME_HUMAN)
SPRRLVELAGQSLLKDEALAIAALE

SEQ ID NO: 347257 - protein, 14 aa, Homo sapiens
  Native (PRAME_HUMAN)
SPSVSQLSVLSLSG

SEQ ID NO: 347258 - protein, 15 aa, Homo sapiens
  Native (PRAME_HUMAN)
SPSVSQLSVLSLSGV

SEQ ID NO: 347259 - protein, 16 aa, Homo sapiens
  Native (PRAME_HUMAN)
SPSVSQLSVLSLSGVM

SEQ ID NO: 347260 - protein, 17 aa, Homo sapiens
  Native (PRAME_HUMAN)
SPSVSQLSVLSLSGVML

SEQ ID NO: 347261 - protein, 18 aa, Homo sapiens
  Native (PRAME_HUMAN)
SPSVSQLSVLSLSGVMLT

SEQ ID NO: 347262 - protein, 19 aa, Homo sapiens
  Native (PRAME_HUMAN)
SPSVSQLSVLSLSGVMLTD

SEQ ID NO: 347263 - protein, 20 aa, Homo sapiens
  Native (PRAME_HUMAN)
SPSVSQLSVLSLSGVMLTDV

SEQ ID NO: 347264 - protein, 21 aa, Homo sapiens
  Native (PRAME_HUMAN)
SPSVSQLSVLSLSGVMLTDVS

SEQ ID NO: 347265 - protein, 22 aa, Homo sapiens
  Native (PRAME_HUMAN)
SPSVSQLSVLSLSGVMLTDVSP

SEQ ID NO: 347266 - protein, 23 aa, Homo sapiens
  Native (PRAME_HUMAN)
SPSVSQLSVLSLSGVMLTDVSPE

SEQ ID NO: 347267 - protein, 24 aa, Homo sapiens
  Native (PRAME_HUMAN)
SPSVSQLSVLSLSGVMLTDVSPEP

SEQ ID NO: 347268 - protein, 25 aa, Homo sapiens
  Native (PRAME_HUMAN)
SPSVSQLSVLSLSGVMLTDVSPEPL

SEQ ID NO: 347269 - protein, 13 aa, Homo sapiens
  Native (PRAME_HUMAN)
SPYLGQMINLRRL

SEQ ID NO: 347270 - protein, 14 aa, Homo sapiens
  Native (PRAME_HUMAN)
SPYLGQMINLRRLL

SEQ ID NO: 347271 - protein, 15 aa, Homo sapiens
  Native (PRAME_HUMAN)
SPYLGQMINLRRLLL

SEQ ID NO: 347272 - protein, 16 aa, Homo sapiens
  Native (PRAME_HUMAN)
SPYLGQMINLRRLLLS

SEQ ID NO: 347273 - protein, 17 aa, Homo sapiens
  Native (PRAME_HUMAN)
SPYLGQMINLRRLLLSH

SEQ ID NO: 347274 - protein, 18 aa, Homo sapiens
  Native (PRAME_HUMAN)
SPYLGQMINLRRLLLSHI

SEQ ID NO: 347275 - protein, 19 aa, Homo sapiens
  Native (PRAME_HUMAN)
SPYLGQMINLRRLLLSHIH

SEQ ID NO: 347276 - protein, 20 aa, Homo sapiens
  Native (PRAME_HUMAN)
SPYLGQMINLRRLLLSHIHA

SEQ ID NO: 347277 - protein, 21 aa, Homo sapiens
  Native (PRAME_HUMAN)
SPYLGQMINLRRLLLSHIHAS

SEQ ID NO: 347278 - protein, 22 aa, Homo sapiens
  Native (PRAME_HUMAN)
SPYLGQMINLRRLLLSHIHASS

SEQ ID NO: 347279 - protein, 23 aa, Homo sapiens
  Native (PRAME_HUMAN)
SPYLGQMINLRRLLLSHIHASSY

SEQ ID NO: 347280 - protein, 24 aa, Homo sapiens
  Native (PRAME_HUMAN)
SPYLGQMINLRRLLLSHIHASSYI

SEQ ID NO: 347281 - protein, 25 aa, Homo sapiens
  Native (PRAME_HUMAN)
SPYLGQMINLRRLLLSHIHASSYIS

SEQ ID NO: 347282 - protein, 13 aa, Homo sapiens
  Native (PRAME_HUMAN)
SQFLSLQCLQALY

SEQ ID NO: 347283 - protein, 14 aa, Homo sapiens
  Native (PRAME_HUMAN)
SQFLSLQCLQALYV

SEQ ID NO: 347284 - protein, 15 aa, Homo sapiens
  Native (PRAME_HUMAN)
SQFLSLQCLQALYVD

SEQ ID NO: 347285 - protein, 16 aa, Homo sapiens
  Native (PRAME_HUMAN)
SQFLSLQCLQALYVDS

SEQ ID NO: 347286 - protein, 17 aa, Homo sapiens
  Native (PRAME_HUMAN)
SQFLSLQCLQALYVDSL

SEQ ID NO: 347287 - protein, 18 aa, Homo sapiens
  Native (PRAME_HUMAN)
SQFLSLQCLQALYVDSLF

SEQ ID NO: 347288 - protein, 19 aa, Homo sapiens
  Native (PRAME_HUMAN)
SQFLSLQCLQALYVDSLFF

SEQ ID NO: 347289 - protein, 20 aa, Homo sapiens
  Native (PRAME_HUMAN)
SQFLSLQCLQALYVDSLFFL

SEQ ID NO: 347290 - protein, 21 aa, Homo sapiens
  Native (PRAME_HUMAN)
SQFLSLQCLQALYVDSLFFLR

SEQ ID NO: 347291 - protein, 22 aa, Homo sapiens
  Native (PRAME_HUMAN)
SQFLSLQCLQALYVDSLFFLRG

SEQ ID NO: 347292 - protein, 23 aa, Homo sapiens
  Native (PRAME_HUMAN)
SQFLSLQCLQALYVDSLFFLRGR

SEQ ID NO: 347293 - protein, 24 aa, Homo sapiens
  Native (PRAME_HUMAN)
SQFLSLQCLQALYVDSLFFLRGRL

SEQ ID NO: 347294 - protein, 25 aa, Homo sapiens
  Native (PRAME_HUMAN)
SQFLSLQCLQALYVDSLFFLRGRLD

SEQ ID NO: 347295 - protein, 13 aa, Homo sapiens
  Native (PRAME_HUMAN)
SQLSVLSLSGVML

SEQ ID NO: 347296 - protein, 14 aa, Homo sapiens
  Native (PRAME_HUMAN)
SQLSVLSLSGVMLT

SEQ ID NO: 347297 - protein, 15 aa, Homo sapiens
  Native (PRAME_HUMAN)
SQLSVLSLSGVMLTD

SEQ ID NO: 347298 - protein, 16 aa, Homo sapiens
  Native (PRAME_HUMAN)
SQLSVLSLSGVMLTDV

SEQ ID NO: 347299 - protein, 17 aa, Homo sapiens
  Native (PRAME_HUMAN)
SQLSVLSLSGVMLTDVS

SEQ ID NO: 347300 - protein, 18 aa, Homo sapiens
  Native (PRAME_HUMAN)
SQLSVLSLSGVMLTDVSP

SEQ ID NO: 347301 - protein, 19 aa, Homo sapiens
  Native (PRAME_HUMAN)
SQLSVLSLSGVMLTDVSPE

SEQ ID NO: 347302 - protein, 20 aa, Homo sapiens
  Native (PRAME_HUMAN)
SQLSVLSLSGVMLTDVSPEP

SEQ ID NO: 347303 - protein, 21 aa, Homo sapiens
  Native (PRAME_HUMAN)
SQLSVLSLSGVMLTDVSPEPL

SEQ ID NO: 347304 - protein, 22 aa, Homo sapiens
  Native (PRAME_HUMAN)
SQLSVLSLSGVMLTDVSPEPLQ

SEQ ID NO: 347305 - protein, 23 aa, Homo sapiens
  Native (PRAME_HUMAN)
SQLSVLSLSGVMLTDVSPEPLQA

SEQ ID NO: 347306 - protein, 24 aa, Homo sapiens
  Native (PRAME_HUMAN)
SQLSVLSLSGVMLTDVSPEPLQAL

SEQ ID NO: 347307 - protein, 25 aa, Homo sapiens
  Native (PRAME_HUMAN)
SQLSVLSLSGVMLTDVSPEPLQALL

SEQ ID NO: 347308 - protein, 13 aa, Homo sapiens
  Native (PRAME_HUMAN)
SQLTTLSFYGNSI

SEQ ID NO: 347309 - protein, 14 aa, Homo sapiens
  Native (PRAME_HUMAN)
SQLTTLSFYGNSIS

SEQ ID NO: 347310 - protein, 15 aa, Homo sapiens
  Native (PRAME_HUMAN)
SQLTTLSFYGNSISI

SEQ ID NO: 347311 - protein, 16 aa, Homo sapiens
  Native (PRAME_HUMAN)
SQLTTLSFYGNSISIS

SEQ ID NO: 347312 - protein, 17 aa, Homo sapiens
  Native (PRAME_HUMAN)
SQLTTLSFYGNSISISA

SEQ ID NO: 347313 - protein, 18 aa, Homo sapiens
  Native (PRAME_HUMAN)
SQLTTLSFYGNSISISAL

SEQ ID NO: 347314 - protein, 19 aa, Homo sapiens
  Native (PRAME_HUMAN)
SQLTTLSFYGNSISISALQ

SEQ ID NO: 347315 - protein, 20 aa, Homo sapiens
  Native (PRAME_HUMAN)
SQLTTLSFYGNSISISALQS

SEQ ID NO: 347316 - protein, 21 aa, Homo sapiens
  Native (PRAME_HUMAN)
SQLTTLSFYGNSISISALQSL

SEQ ID NO: 347317 - protein, 22 aa, Homo sapiens
  Native (PRAME_HUMAN)
SQLTTLSFYGNSISISALQSLL

SEQ ID NO: 347318 - protein, 23 aa, Homo sapiens
  Native (PRAME_HUMAN)
SQLTTLSFYGNSISISALQSLLQ

SEQ ID NO: 347319 - protein, 24 aa, Homo sapiens
  Native (PRAME_HUMAN)
SQLTTLSFYGNSISISALQSLLQH

SEQ ID NO: 347320 - protein, 25 aa, Homo sapiens
  Native (PRAME_HUMAN)
SQLTTLSFYGNSISISALQSLLQHL

SEQ ID NO: 347321 - protein, 14 aa, Homo sapiens
  Native (PRAME_HUMAN)
SQSPSVSQLSVLSL

SEQ ID NO: 347322 - protein, 15 aa, Homo sapiens
  Native (PRAME_HUMAN)
SQSPSVSQLSVLSLS

SEQ ID NO: 347323 - protein, 16 aa, Homo sapiens
  Native (PRAME_HUMAN)
SQSPSVSQLSVLSLSG

SEQ ID NO: 347324 - protein, 17 aa, Homo sapiens
  Native (PRAME_HUMAN)
SQSPSVSQLSVLSLSGV

SEQ ID NO: 347325 - protein, 18 aa, Homo sapiens
  Native (PRAME_HUMAN)
SQSPSVSQLSVLSLSGVM

SEQ ID NO: 347326 - protein, 19 aa, Homo sapiens
  Native (PRAME_HUMAN)
SQSPSVSQLSVLSLSGVML

SEQ ID NO: 347327 - protein, 20 aa, Homo sapiens
  Native (PRAME_HUMAN)
SQSPSVSQLSVLSLSGVMLT

SEQ ID NO: 347328 - protein, 21 aa, Homo sapiens
  Native (PRAME_HUMAN)
SQSPSVSQLSVLSLSGVMLTD

SEQ ID NO: 347329 - protein, 22 aa, Homo sapiens
  Native (PRAME_HUMAN)
SQSPSVSQLSVLSLSGVMLTDV

SEQ ID NO: 347330 - protein, 23 aa, Homo sapiens
  Native (PRAME_HUMAN)
SQSPSVSQLSVLSLSGVMLTDVS

SEQ ID NO: 347331 - protein, 24 aa, Homo sapiens
  Native (PRAME_HUMAN)
SQSPSVSQLSVLSLSGVMLTDVSP

SEQ ID NO: 347332 - protein, 25 aa, Homo sapiens
  Native (PRAME_HUMAN)
SQSPSVSQLSVLSLSGVMLTDVSPE

SEQ ID NO: 347333 - protein, 14 aa, Homo sapiens
  Native (PRAME_HUMAN)
SQTLKAMVQAWPFT

SEQ ID NO: 347334 - protein, 15 aa, Homo sapiens
  Native (PRAME_HUMAN)
SQTLKAMVQAWPFTC

SEQ ID NO: 347335 - protein, 16 aa, Homo sapiens
  Native (PRAME_HUMAN)
SQTLKAMVQAWPFTCL

SEQ ID NO: 347336 - protein, 17 aa, Homo sapiens
  Native (PRAME_HUMAN)
SQTLKAMVQAWPFTCLP

SEQ ID NO: 347337 - protein, 18 aa, Homo sapiens
  Native (PRAME_HUMAN)
SQTLKAMVQAWPFTCLPL

SEQ ID NO: 347338 - protein, 19 aa, Homo sapiens
  Native (PRAME_HUMAN)
SQTLKAMVQAWPFTCLPLG

SEQ ID NO: 347339 - protein, 20 aa, Homo sapiens
  Native (PRAME_HUMAN)
SQTLKAMVQAWPFTCLPLGV

SEQ ID NO: 347340 - protein, 21 aa, Homo sapiens
  Native (PRAME_HUMAN)
SQTLKAMVQAWPFTCLPLGVL

SEQ ID NO: 347341 - protein, 22 aa, Homo sapiens
  Native (PRAME_HUMAN)
SQTLKAMVQAWPFTCLPLGVLM

SEQ ID NO: 347342 - protein, 23 aa, Homo sapiens
  Native (PRAME_HUMAN)
SQTLKAMVQAWPFTCLPLGVLMK

SEQ ID NO: 347343 - protein, 24 aa, Homo sapiens
  Native (PRAME_HUMAN)
SQTLKAMVQAWPFTCLPLGVLMKG

SEQ ID NO: 347344 - protein, 25 aa, Homo sapiens
  Native (PRAME_HUMAN)
SQTLKAMVQAWPFTCLPLGVLMKGQ

SEQ ID NO: 347345 - protein, 13 aa, Homo sapiens
  Native (PRAME_HUMAN)
SRYISMSVWTSPR

SEQ ID NO: 347346 - protein, 14 aa, Homo sapiens
  Native (PRAME_HUMAN)
SRYISMSVWTSPRR

SEQ ID NO: 347347 - protein, 15 aa, Homo sapiens
  Native (PRAME_HUMAN)
SRYISMSVWTSPRRL

SEQ ID NO: 347348 - protein, 16 aa, Homo sapiens
  Native (PRAME_HUMAN)
SRYISMSVWTSPRRLV

SEQ ID NO: 347349 - protein, 17 aa, Homo sapiens
  Native (PRAME_HUMAN)
SRYISMSVWTSPRRLVE

SEQ ID NO: 347350 - protein, 18 aa, Homo sapiens
  Native (PRAME_HUMAN)
SRYISMSVWTSPRRLVEL

SEQ ID NO: 347351 - protein, 19 aa, Homo sapiens
  Native (PRAME_HUMAN)
SRYISMSVWTSPRRLVELA

SEQ ID NO: 347352 - protein, 20 aa, Homo sapiens
  Native (PRAME_HUMAN)
SRYISMSVWTSPRRLVELAG

SEQ ID NO: 347353 - protein, 21 aa, Homo sapiens
  Native (PRAME_HUMAN)
SRYISMSVWTSPRRLVELAGQ

SEQ ID NO: 347354 - protein, 22 aa, Homo sapiens
  Native (PRAME_HUMAN)
SRYISMSVWTSPRRLVELAGQS

SEQ ID NO: 347355 - protein, 23 aa, Homo sapiens
  Native (PRAME_HUMAN)
SRYISMSVWTSPRRLVELAGQSL

SEQ ID NO: 347356 - protein, 24 aa, Homo sapiens
  Native (PRAME_HUMAN)
SRYISMSVWTSPRRLVELAGQSLL

SEQ ID NO: 347357 - protein, 25 aa, Homo sapiens
  Native (PRAME_HUMAN)
SRYISMSVWTSPRRLVELAGQSLLK

SEQ ID NO: 347358 - protein, 20 aa, Homo sapiens
  Native (PRAME_HUMAN)
SSYISPEKEEQYIAQFTSQF

SEQ ID NO: 347359 - protein, 21 aa, Homo sapiens
  Native (PRAME_HUMAN)
SSYISPEKEEQYIAQFTSQFL

SEQ ID NO: 347360 - protein, 22 aa, Homo sapiens
  Native (PRAME_HUMAN)
SSYISPEKEEQYIAQFTSQFLS

SEQ ID NO: 347361 - protein, 23 aa, Homo sapiens
  Native (PRAME_HUMAN)
SSYISPEKEEQYIAQFTSQFLSL

SEQ ID NO: 347362 - protein, 24 aa, Homo sapiens
  Native (PRAME_HUMAN)
SSYISPEKEEQYIAQFTSQFLSLQ

SEQ ID NO: 347363 - protein, 25 aa, Homo sapiens
  Native (PRAME_HUMAN)
SSYISPEKEEQYIAQFTSQFLSLQC

SEQ ID NO: 347364 - protein, 15 aa, Homo sapiens
  Native (PRAME_HUMAN)
STEAEQPFIPVEVLV

SEQ ID NO: 347365 - protein, 16 aa, Homo sapiens
  Native (PRAME_HUMAN)
STEAEQPFIPVEVLVD

SEQ ID NO: 347366 - protein, 17 aa, Homo sapiens
  Native (PRAME_HUMAN)
STEAEQPFIPVEVLVDL

SEQ ID NO: 347367 - protein, 18 aa, Homo sapiens
  Native (PRAME_HUMAN)
STEAEQPFIPVEVLVDLF

SEQ ID NO: 347368 - protein, 19 aa, Homo sapiens
  Native (PRAME_HUMAN)
STEAEQPFIPVEVLVDLFL

SEQ ID NO: 347369 - protein, 20 aa, Homo sapiens
  Native (PRAME_HUMAN)
STEAEQPFIPVEVLVDLFLK

SEQ ID NO: 347370 - protein, 21 aa, Homo sapiens
  Native (PRAME_HUMAN)
STEAEQPFIPVEVLVDLFLKE

SEQ ID NO: 347371 - protein, 22 aa, Homo sapiens
  Native (PRAME_HUMAN)
STEAEQPFIPVEVLVDLFLKEG

SEQ ID NO: 347372 - protein, 23 aa, Homo sapiens
  Native (PRAME_HUMAN)
STEAEQPFIPVEVLVDLFLKEGA

SEQ ID NO: 347373 - protein, 24 aa, Homo sapiens
  Native (PRAME_HUMAN)
STEAEQPFIPVEVLVDLFLKEGAC

SEQ ID NO: 347374 - protein, 25 aa, Homo sapiens
  Native (PRAME_HUMAN)
STEAEQPFIPVEVLVDLFLKEGACD

SEQ ID NO: 347375 - protein, 13 aa, Homo sapiens
  Native (PRAME_HUMAN)
SVLSLSGVMLTDV

SEQ ID NO: 347376 - protein, 14 aa, Homo sapiens
  Native (PRAME_HUMAN)
SVLSLSGVMLTDVS

SEQ ID NO: 347377 - protein, 15 aa, Homo sapiens
  Native (PRAME_HUMAN)
SVLSLSGVMLTDVSP

SEQ ID NO: 347378 - protein, 16 aa, Homo sapiens
  Native (PRAME_HUMAN)
SVLSLSGVMLTDVSPE

SEQ ID NO: 347379 - protein, 17 aa, Homo sapiens
  Native (PRAME_HUMAN)
SVLSLSGVMLTDVSPEP

SEQ ID NO: 347380 - protein, 18 aa, Homo sapiens
  Native (PRAME_HUMAN)
SVLSLSGVMLTDVSPEPL

SEQ ID NO: 347381 - protein, 19 aa, Homo sapiens
  Native (PRAME_HUMAN)
SVLSLSGVMLTDVSPEPLQ

SEQ ID NO: 347382 - protein, 20 aa, Homo sapiens
  Native (PRAME_HUMAN)
SVLSLSGVMLTDVSPEPLQA

SEQ ID NO: 347383 - protein, 21 aa, Homo sapiens
  Native (PRAME_HUMAN)
SVLSLSGVMLTDVSPEPLQAL

SEQ ID NO: 347384 - protein, 22 aa, Homo sapiens
  Native (PRAME_HUMAN)
SVLSLSGVMLTDVSPEPLQALL

SEQ ID NO: 347385 - protein, 23 aa, Homo sapiens
  Native (PRAME_HUMAN)
SVLSLSGVMLTDVSPEPLQALLE

SEQ ID NO: 347386 - protein, 24 aa, Homo sapiens
  Native (PRAME_HUMAN)
SVLSLSGVMLTDVSPEPLQALLER

SEQ ID NO: 347387 - protein, 25 aa, Homo sapiens
  Native (PRAME_HUMAN)
SVLSLSGVMLTDVSPEPLQALLERA

SEQ ID NO: 347388 - protein, 13 aa, Homo sapiens
  Native (PRAME_HUMAN)
SVSQLSVLSLSGV

SEQ ID NO: 347389 - protein, 14 aa, Homo sapiens
  Native (PRAME_HUMAN)
SVSQLSVLSLSGVM

SEQ ID NO: 347390 - protein, 15 aa, Homo sapiens
  Native (PRAME_HUMAN)
SVSQLSVLSLSGVML

SEQ ID NO: 347391 - protein, 16 aa, Homo sapiens
  Native (PRAME_HUMAN)
SVSQLSVLSLSGVMLT

SEQ ID NO: 347392 - protein, 17 aa, Homo sapiens
  Native (PRAME_HUMAN)
SVSQLSVLSLSGVMLTD

SEQ ID NO: 347393 - protein, 18 aa, Homo sapiens
  Native (PRAME_HUMAN)
SVSQLSVLSLSGVMLTDV

SEQ ID NO: 347394 - protein, 19 aa, Homo sapiens
  Native (PRAME_HUMAN)
SVSQLSVLSLSGVMLTDVS

SEQ ID NO: 347395 - protein, 20 aa, Homo sapiens
  Native (PRAME_HUMAN)
SVSQLSVLSLSGVMLTDVSP

SEQ ID NO: 347396 - protein, 21 aa, Homo sapiens
  Native (PRAME_HUMAN)
SVSQLSVLSLSGVMLTDVSPE

SEQ ID NO: 347397 - protein, 22 aa, Homo sapiens
  Native (PRAME_HUMAN)
SVSQLSVLSLSGVMLTDVSPEP

SEQ ID NO: 347398 - protein, 23 aa, Homo sapiens
  Native (PRAME_HUMAN)
SVSQLSVLSLSGVMLTDVSPEPL

SEQ ID NO: 347399 - protein, 24 aa, Homo sapiens
  Native (PRAME_HUMAN)
SVSQLSVLSLSGVMLTDVSPEPLQ

SEQ ID NO: 347400 - protein, 25 aa, Homo sapiens
  Native (PRAME_HUMAN)
SVSQLSVLSLSGVMLTDVSPEPLQA

SEQ ID NO: 347401 - protein, 14 aa, Homo sapiens
  Native (PRAME_HUMAN)
SVWTSPRRLVELAG

SEQ ID NO: 347402 - protein, 15 aa, Homo sapiens
  Native (PRAME_HUMAN)
SVWTSPRRLVELAGQ

SEQ ID NO: 347403 - protein, 16 aa, Homo sapiens
  Native (PRAME_HUMAN)
SVWTSPRRLVELAGQS

SEQ ID NO: 347404 - protein, 17 aa, Homo sapiens
  Native (PRAME_HUMAN)
SVWTSPRRLVELAGQSL

SEQ ID NO: 347405 - protein, 18 aa, Homo sapiens
  Native (PRAME_HUMAN)
SVWTSPRRLVELAGQSLL

SEQ ID NO: 347406 - protein, 19 aa, Homo sapiens
  Native (PRAME_HUMAN)
SVWTSPRRLVELAGQSLLK

SEQ ID NO: 347407 - protein, 20 aa, Homo sapiens
  Native (PRAME_HUMAN)
SVWTSPRRLVELAGQSLLKD

SEQ ID NO: 347408 - protein, 21 aa, Homo sapiens
  Native (PRAME_HUMAN)
SVWTSPRRLVELAGQSLLKDE

SEQ ID NO: 347409 - protein, 22 aa, Homo sapiens
  Native (PRAME_HUMAN)
SVWTSPRRLVELAGQSLLKDEA

SEQ ID NO: 347410 - protein, 23 aa, Homo sapiens
  Native (PRAME_HUMAN)
SVWTSPRRLVELAGQSLLKDEAL

SEQ ID NO: 347411 - protein, 24 aa, Homo sapiens
  Native (PRAME_HUMAN)
SVWTSPRRLVELAGQSLLKDEALA

SEQ ID NO: 347412 - protein, 25 aa, Homo sapiens
  Native (PRAME_HUMAN)
SVWTSPRRLVELAGQSLLKDEALAI

SEQ ID NO: 347413 - protein, 14 aa, Homo sapiens
  Native (PRAME_HUMAN)
SYEDIHGTLHLERL

SEQ ID NO: 347414 - protein, 15 aa, Homo sapiens
  Native (PRAME_HUMAN)
SYEDIHGTLHLERLA

SEQ ID NO: 347415 - protein, 16 aa, Homo sapiens
  Native (PRAME_HUMAN)
SYEDIHGTLHLERLAY

SEQ ID NO: 347416 - protein, 17 aa, Homo sapiens
  Native (PRAME_HUMAN)
SYEDIHGTLHLERLAYL

SEQ ID NO: 347417 - protein, 18 aa, Homo sapiens
  Native (PRAME_HUMAN)
SYEDIHGTLHLERLAYLH

SEQ ID NO: 347418 - protein, 19 aa, Homo sapiens
  Native (PRAME_HUMAN)
SYEDIHGTLHLERLAYLHA

SEQ ID NO: 347419 - protein, 20 aa, Homo sapiens
  Native (PRAME_HUMAN)
SYEDIHGTLHLERLAYLHAR

SEQ ID NO: 347420 - protein, 21 aa, Homo sapiens
  Native (PRAME_HUMAN)
SYEDIHGTLHLERLAYLHARL

SEQ ID NO: 347421 - protein, 22 aa, Homo sapiens
  Native (PRAME_HUMAN)
SYEDIHGTLHLERLAYLHARLR

SEQ ID NO: 347422 - protein, 23 aa, Homo sapiens
  Native (PRAME_HUMAN)
SYEDIHGTLHLERLAYLHARLRE

SEQ ID NO: 347423 - protein, 24 aa, Homo sapiens
  Native (PRAME_HUMAN)
SYEDIHGTLHLERLAYLHARLREL

SEQ ID NO: 347424 - protein, 25 aa, Homo sapiens
  Native (PRAME_HUMAN)
SYEDIHGTLHLERLAYLHARLRELL

SEQ ID NO: 347425 - protein, 19 aa, Homo sapiens
  Native (PRAME_HUMAN)
SYISPEKEEQYIAQFTSQF

SEQ ID NO: 347426 - protein, 20 aa, Homo sapiens
  Native (PRAME_HUMAN)
SYISPEKEEQYIAQFTSQFL

SEQ ID NO: 347427 - protein, 21 aa, Homo sapiens
  Native (PRAME_HUMAN)
SYISPEKEEQYIAQFTSQFLS

SEQ ID NO: 347428 - protein, 22 aa, Homo sapiens
  Native (PRAME_HUMAN)
SYISPEKEEQYIAQFTSQFLSL

SEQ ID NO: 347429 - protein, 23 aa, Homo sapiens
  Native (PRAME_HUMAN)
SYISPEKEEQYIAQFTSQFLSLQ

SEQ ID NO: 347430 - protein, 24 aa, Homo sapiens
  Native (PRAME_HUMAN)
SYISPEKEEQYIAQFTSQFLSLQC

SEQ ID NO: 347431 - protein, 25 aa, Homo sapiens
  Native (PRAME_HUMAN)
SYISPEKEEQYIAQFTSQFLSLQCL

SEQ ID NO: 347432 - protein, 13 aa, Homo sapiens
  Native (PRAME_HUMAN)
SYLIEKVKRKKNV

SEQ ID NO: 347433 - protein, 14 aa, Homo sapiens
  Native (PRAME_HUMAN)
SYLIEKVKRKKNVL

SEQ ID NO: 347434 - protein, 15 aa, Homo sapiens
  Native (PRAME_HUMAN)
SYLIEKVKRKKNVLR

SEQ ID NO: 347435 - protein, 16 aa, Homo sapiens
  Native (PRAME_HUMAN)
SYLIEKVKRKKNVLRL

SEQ ID NO: 347436 - protein, 17 aa, Homo sapiens
  Native (PRAME_HUMAN)
SYLIEKVKRKKNVLRLC

SEQ ID NO: 347437 - protein, 18 aa, Homo sapiens
  Native (PRAME_HUMAN)
SYLIEKVKRKKNVLRLCC

SEQ ID NO: 347438 - protein, 19 aa, Homo sapiens
  Native (PRAME_HUMAN)
SYLIEKVKRKKNVLRLCCK

SEQ ID NO: 347439 - protein, 20 aa, Homo sapiens
  Native (PRAME_HUMAN)
SYLIEKVKRKKNVLRLCCKK

SEQ ID NO: 347440 - protein, 21 aa, Homo sapiens
  Native (PRAME_HUMAN)
SYLIEKVKRKKNVLRLCCKKL

SEQ ID NO: 347441 - protein, 22 aa, Homo sapiens
  Native (PRAME_HUMAN)
SYLIEKVKRKKNVLRLCCKKLK

SEQ ID NO: 347442 - protein, 23 aa, Homo sapiens
  Native (PRAME_HUMAN)
SYLIEKVKRKKNVLRLCCKKLKI

SEQ ID NO: 347443 - protein, 24 aa, Homo sapiens
  Native (PRAME_HUMAN)
SYLIEKVKRKKNVLRLCCKKLKIF

SEQ ID NO: 347444 - protein, 25 aa, Homo sapiens
  Native (PRAME_HUMAN)
SYLIEKVKRKKNVLRLCCKKLKIFA

SEQ ID NO: 347445 - protein, 14 aa, Homo sapiens
  Native (PRAME_HUMAN)
TCLPLGVLMKGQHL

SEQ ID NO: 347446 - protein, 16 aa, Homo sapiens
  Native (PRAME_HUMAN)
TCLPLGVLMKGQHLHL

SEQ ID NO: 347447 - protein, 17 aa, Homo sapiens
  Native (PRAME_HUMAN)
TCLPLGVLMKGQHLHLE

SEQ ID NO: 347448 - protein, 18 aa, Homo sapiens
  Native (PRAME_HUMAN)
TCLPLGVLMKGQHLHLET

SEQ ID NO: 347449 - protein, 19 aa, Homo sapiens
  Native (PRAME_HUMAN)
TCLPLGVLMKGQHLHLETF

SEQ ID NO: 347450 - protein, 20 aa, Homo sapiens
  Native (PRAME_HUMAN)
TCLPLGVLMKGQHLHLETFK

SEQ ID NO: 347451 - protein, 21 aa, Homo sapiens
  Native (PRAME_HUMAN)
TCLPLGVLMKGQHLHLETFKA

SEQ ID NO: 347452 - protein, 22 aa, Homo sapiens
  Native (PRAME_HUMAN)
TCLPLGVLMKGQHLHLETFKAV

SEQ ID NO: 347453 - protein, 23 aa, Homo sapiens
  Native (PRAME_HUMAN)
TCLPLGVLMKGQHLHLETFKAVL

SEQ ID NO: 347454 - protein, 24 aa, Homo sapiens
  Native (PRAME_HUMAN)
TCLPLGVLMKGQHLHLETFKAVLD

SEQ ID NO: 347455 - protein, 25 aa, Homo sapiens
  Native (PRAME_HUMAN)
TCLPLGVLMKGQHLHLETFKAVLDG

SEQ ID NO: 347456 - protein, 15 aa, Homo sapiens
  Native (PRAME_HUMAN)
TCTWKLPTLAKFSPY

SEQ ID NO: 347457 - protein, 16 aa, Homo sapiens
  Native (PRAME_HUMAN)
TCTWKLPTLAKFSPYL

SEQ ID NO: 347458 - protein, 17 aa, Homo sapiens
  Native (PRAME_HUMAN)
TCTWKLPTLAKFSPYLG

SEQ ID NO: 347459 - protein, 18 aa, Homo sapiens
  Native (PRAME_HUMAN)
TCTWKLPTLAKFSPYLGQ

SEQ ID NO: 347460 - protein, 19 aa, Homo sapiens
  Native (PRAME_HUMAN)
TCTWKLPTLAKFSPYLGQM

SEQ ID NO: 347461 - protein, 20 aa, Homo sapiens
  Native (PRAME_HUMAN)
TCTWKLPTLAKFSPYLGQMI

SEQ ID NO: 347462 - protein, 21 aa, Homo sapiens
  Native (PRAME_HUMAN)
TCTWKLPTLAKFSPYLGQMIN

SEQ ID NO: 347463 - protein, 22 aa, Homo sapiens
  Native (PRAME_HUMAN)
TCTWKLPTLAKFSPYLGQMINL

SEQ ID NO: 347464 - protein, 23 aa, Homo sapiens
  Native (PRAME_HUMAN)
TCTWKLPTLAKFSPYLGQMINLR

SEQ ID NO: 347465 - protein, 24 aa, Homo sapiens
  Native (PRAME_HUMAN)
TCTWKLPTLAKFSPYLGQMINLRR

SEQ ID NO: 347466 - protein, 25 aa, Homo sapiens
  Native (PRAME_HUMAN)
TCTWKLPTLAKFSPYLGQMINLRRL

SEQ ID NO: 347467 - protein, 13 aa, Homo sapiens
  Native (PRAME_HUMAN)
TDDQLLALLPSLS

SEQ ID NO: 347468 - protein, 14 aa, Homo sapiens
  Native (PRAME_HUMAN)
TDDQLLALLPSLSH

SEQ ID NO: 347469 - protein, 15 aa, Homo sapiens
  Native (PRAME_HUMAN)
TDDQLLALLPSLSHC

SEQ ID NO: 347470 - protein, 16 aa, Homo sapiens
  Native (PRAME_HUMAN)
TDDQLLALLPSLSHCS

SEQ ID NO: 347471 - protein, 17 aa, Homo sapiens
  Native (PRAME_HUMAN)
TDDQLLALLPSLSHCSQ

SEQ ID NO: 347472 - protein, 18 aa, Homo sapiens
  Native (PRAME_HUMAN)
TDDQLLALLPSLSHCSQL

SEQ ID NO: 347473 - protein, 19 aa, Homo sapiens
  Native (PRAME_HUMAN)
TDDQLLALLPSLSHCSQLT

SEQ ID NO: 347474 - protein, 20 aa, Homo sapiens
  Native (PRAME_HUMAN)
TDDQLLALLPSLSHCSQLTT

SEQ ID NO: 347475 - protein, 21 aa, Homo sapiens
  Native (PRAME_HUMAN)
TDDQLLALLPSLSHCSQLTTL

SEQ ID NO: 347476 - protein, 22 aa, Homo sapiens
  Native (PRAME_HUMAN)
TDDQLLALLPSLSHCSQLTTLS

SEQ ID NO: 347477 - protein, 23 aa, Homo sapiens
  Native (PRAME_HUMAN)
TDDQLLALLPSLSHCSQLTTLSF

SEQ ID NO: 347478 - protein, 24 aa, Homo sapiens
  Native (PRAME_HUMAN)
TDDQLLALLPSLSHCSQLTTLSFY

SEQ ID NO: 347479 - protein, 25 aa, Homo sapiens
  Native (PRAME_HUMAN)
TDDQLLALLPSLSHCSQLTTLSFYG

SEQ ID NO: 347480 - protein, 15 aa, Homo sapiens
  Native (PRAME_HUMAN)
TDVSPEPLQALLERA

SEQ ID NO: 347481 - protein, 16 aa, Homo sapiens
  Native (PRAME_HUMAN)
TDVSPEPLQALLERAS

SEQ ID NO: 347482 - protein, 17 aa, Homo sapiens
  Native (PRAME_HUMAN)
TDVSPEPLQALLERASA

SEQ ID NO: 347483 - protein, 19 aa, Homo sapiens
  Native (PRAME_HUMAN)
TDVSPEPLQALLERASATL

SEQ ID NO: 347484 - protein, 20 aa, Homo sapiens
  Native (PRAME_HUMAN)
TDVSPEPLQALLERASATLQ

SEQ ID NO: 347485 - protein, 21 aa, Homo sapiens
  Native (PRAME_HUMAN)
TDVSPEPLQALLERASATLQD

SEQ ID NO: 347486 - protein, 22 aa, Homo sapiens
  Native (PRAME_HUMAN)
TDVSPEPLQALLERASATLQDL

SEQ ID NO: 347487 - protein, 23 aa, Homo sapiens
  Native (PRAME_HUMAN)
TDVSPEPLQALLERASATLQDLV

SEQ ID NO: 347488 - protein, 24 aa, Homo sapiens
  Native (PRAME_HUMAN)
TDVSPEPLQALLERASATLQDLVF

SEQ ID NO: 347489 - protein, 25 aa, Homo sapiens
  Native (PRAME_HUMAN)
TDVSPEPLQALLERASATLQDLVFD

SEQ ID NO: 347490 - protein, 15 aa, Homo sapiens
  Native (PRAME_HUMAN)
TEAEQPFIPVEVLVD

SEQ ID NO: 347491 - protein, 16 aa, Homo sapiens
  Native (PRAME_HUMAN)
TEAEQPFIPVEVLVDL

SEQ ID NO: 347492 - protein, 17 aa, Homo sapiens
  Native (PRAME_HUMAN)
TEAEQPFIPVEVLVDLF

SEQ ID NO: 347493 - protein, 18 aa, Homo sapiens
  Native (PRAME_HUMAN)
TEAEQPFIPVEVLVDLFL

SEQ ID NO: 347494 - protein, 19 aa, Homo sapiens
  Native (PRAME_HUMAN)
TEAEQPFIPVEVLVDLFLK

SEQ ID NO: 347495 - protein, 20 aa, Homo sapiens
  Native (PRAME_HUMAN)
TEAEQPFIPVEVLVDLFLKE

SEQ ID NO: 347496 - protein, 21 aa, Homo sapiens
  Native (PRAME_HUMAN)
TEAEQPFIPVEVLVDLFLKEG

SEQ ID NO: 347497 - protein, 22 aa, Homo sapiens
  Native (PRAME_HUMAN)
TEAEQPFIPVEVLVDLFLKEGA

SEQ ID NO: 347498 - protein, 24 aa, Homo sapiens
  Native (PRAME_HUMAN)
TEAEQPFIPVEVLVDLFLKEGACD

SEQ ID NO: 347499 - protein, 25 aa, Homo sapiens
  Native (PRAME_HUMAN)
TEAEQPFIPVEVLVDLFLKEGACDE

SEQ ID NO: 347500 - protein, 13 aa, Homo sapiens
  Native (PRAME_HUMAN)
TFKAVLDGLDVLL

SEQ ID NO: 347501 - protein, 14 aa, Homo sapiens
  Native (PRAME_HUMAN)
TFKAVLDGLDVLLA

SEQ ID NO: 347502 - protein, 15 aa, Homo sapiens
  Native (PRAME_HUMAN)
TFKAVLDGLDVLLAQ

SEQ ID NO: 347503 - protein, 16 aa, Homo sapiens
  Native (PRAME_HUMAN)
TFKAVLDGLDVLLAQE

SEQ ID NO: 347504 - protein, 17 aa, Homo sapiens
  Native (PRAME_HUMAN)
TFKAVLDGLDVLLAQEV

SEQ ID NO: 347505 - protein, 18 aa, Homo sapiens
  Native (PRAME_HUMAN)
TFKAVLDGLDVLLAQEVR

SEQ ID NO: 347506 - protein, 19 aa, Homo sapiens
  Native (PRAME_HUMAN)
TFKAVLDGLDVLLAQEVRP

SEQ ID NO: 347507 - protein, 20 aa, Homo sapiens
  Native (PRAME_HUMAN)
TFKAVLDGLDVLLAQEVRPR

SEQ ID NO: 347508 - protein, 21 aa, Homo sapiens
  Native (PRAME_HUMAN)
TFKAVLDGLDVLLAQEVRPRR

SEQ ID NO: 347509 - protein, 22 aa, Homo sapiens
  Native (PRAME_HUMAN)
TFKAVLDGLDVLLAQEVRPRRW

SEQ ID NO: 347510 - protein, 23 aa, Homo sapiens
  Native (PRAME_HUMAN)
TFKAVLDGLDVLLAQEVRPRRWK

SEQ ID NO: 347511 - protein, 24 aa, Homo sapiens
  Native (PRAME_HUMAN)
TFKAVLDGLDVLLAQEVRPRRWKL

SEQ ID NO: 347512 - protein, 25 aa, Homo sapiens
  Native (PRAME_HUMAN)
TFKAVLDGLDVLLAQEVRPRRWKLQ

SEQ ID NO: 347513 - protein, 13 aa, Homo sapiens
  Native (PRAME_HUMAN)
THVLYPVPLESYE

SEQ ID NO: 347514 - protein, 14 aa, Homo sapiens
  Native (PRAME_HUMAN)
THVLYPVPLESYED

SEQ ID NO: 347515 - protein, 15 aa, Homo sapiens
  Native (PRAME_HUMAN)
THVLYPVPLESYEDI

SEQ ID NO: 347516 - protein, 16 aa, Homo sapiens
  Native (PRAME_HUMAN)
THVLYPVPLESYEDIH

SEQ ID NO: 347517 - protein, 17 aa, Homo sapiens
  Native (PRAME_HUMAN)
THVLYPVPLESYEDIHG

SEQ ID NO: 347518 - protein, 18 aa, Homo sapiens
  Native (PRAME_HUMAN)
THVLYPVPLESYEDIHGT

SEQ ID NO: 347519 - protein, 19 aa, Homo sapiens
  Native (PRAME_HUMAN)
THVLYPVPLESYEDIHGTL

SEQ ID NO: 347520 - protein, 20 aa, Homo sapiens
  Native (PRAME_HUMAN)
THVLYPVPLESYEDIHGTLH

SEQ ID NO: 347521 - protein, 21 aa, Homo sapiens
  Native (PRAME_HUMAN)
THVLYPVPLESYEDIHGTLHL

SEQ ID NO: 347522 - protein, 22 aa, Homo sapiens
  Native (PRAME_HUMAN)
THVLYPVPLESYEDIHGTLHLE

SEQ ID NO: 347523 - protein, 23 aa, Homo sapiens
  Native (PRAME_HUMAN)
THVLYPVPLESYEDIHGTLHLER

SEQ ID NO: 347524 - protein, 24 aa, Homo sapiens
  Native (PRAME_HUMAN)
THVLYPVPLESYEDIHGTLHLERL

SEQ ID NO: 347525 - protein, 25 aa, Homo sapiens
  Native (PRAME_HUMAN)
THVLYPVPLESYEDIHGTLHLERLA

SEQ ID NO: 347526 - protein, 17 aa, Homo sapiens
  Native (PRAME_HUMAN)
TKKRKVDGLSTEAEQPF

SEQ ID NO: 347527 - protein, 18 aa, Homo sapiens
  Native (PRAME_HUMAN)
TKKRKVDGLSTEAEQPFI

SEQ ID NO: 347528 - protein, 19 aa, Homo sapiens
  Native (PRAME_HUMAN)
TKKRKVDGLSTEAEQPFIP

SEQ ID NO: 347529 - protein, 20 aa, Homo sapiens
  Native (PRAME_HUMAN)
TKKRKVDGLSTEAEQPFIPV

SEQ ID NO: 347530 - protein, 21 aa, Homo sapiens
  Native (PRAME_HUMAN)
TKKRKVDGLSTEAEQPFIPVE

SEQ ID NO: 347531 - protein, 22 aa, Homo sapiens
  Native (PRAME_HUMAN)
TKKRKVDGLSTEAEQPFIPVEV

SEQ ID NO: 347532 - protein, 23 aa, Homo sapiens
  Native (PRAME_HUMAN)
TKKRKVDGLSTEAEQPFIPVEVL

SEQ ID NO: 347533 - protein, 24 aa, Homo sapiens
  Native (PRAME_HUMAN)
TKKRKVDGLSTEAEQPFIPVEVLV

SEQ ID NO: 347534 - protein, 25 aa, Homo sapiens
  Native (PRAME_HUMAN)
TKKRKVDGLSTEAEQPFIPVEVLVD

SEQ ID NO: 347535 - protein, 13 aa, Homo sapiens
  Native (PRAME_HUMAN)
TLAKFSPYLGQMI

SEQ ID NO: 347536 - protein, 14 aa, Homo sapiens
  Native (PRAME_HUMAN)
TLAKFSPYLGQMIN

SEQ ID NO: 347537 - protein, 15 aa, Homo sapiens
  Native (PRAME_HUMAN)
TLAKFSPYLGQMINL

SEQ ID NO: 347538 - protein, 16 aa, Homo sapiens
  Native (PRAME_HUMAN)
TLAKFSPYLGQMINLR

SEQ ID NO: 347539 - protein, 17 aa, Homo sapiens
  Native (PRAME_HUMAN)
TLAKFSPYLGQMINLRR

SEQ ID NO: 347540 - protein, 18 aa, Homo sapiens
  Native (PRAME_HUMAN)
TLAKFSPYLGQMINLRRL

SEQ ID NO: 347541 - protein, 19 aa, Homo sapiens
  Native (PRAME_HUMAN)
TLAKFSPYLGQMINLRRLL

SEQ ID NO: 347542 - protein, 20 aa, Homo sapiens
  Native (PRAME_HUMAN)
TLAKFSPYLGQMINLRRLLL

SEQ ID NO: 347543 - protein, 21 aa, Homo sapiens
  Native (PRAME_HUMAN)
TLAKFSPYLGQMINLRRLLLS

SEQ ID NO: 347544 - protein, 22 aa, Homo sapiens
  Native (PRAME_HUMAN)
TLAKFSPYLGQMINLRRLLLSH

SEQ ID NO: 347545 - protein, 23 aa, Homo sapiens
  Native (PRAME_HUMAN)
TLAKFSPYLGQMINLRRLLLSHI

SEQ ID NO: 347546 - protein, 24 aa, Homo sapiens
  Native (PRAME_HUMAN)
TLAKFSPYLGQMINLRRLLLSHIH

SEQ ID NO: 347547 - protein, 25 aa, Homo sapiens
  Native (PRAME_HUMAN)
TLAKFSPYLGQMINLRRLLLSHIHA

SEQ ID NO: 347548 - protein, 13 aa, Homo sapiens
  Native (PRAME_HUMAN)
TLHLERLAYLHAR

SEQ ID NO: 347549 - protein, 14 aa, Homo sapiens
  Native (PRAME_HUMAN)
TLHLERLAYLHARL

SEQ ID NO: 347550 - protein, 15 aa, Homo sapiens
  Native (PRAME_HUMAN)
TLHLERLAYLHARLR

SEQ ID NO: 347551 - protein, 16 aa, Homo sapiens
  Native (PRAME_HUMAN)
TLHLERLAYLHARLRE

SEQ ID NO: 347552 - protein, 17 aa, Homo sapiens
  Native (PRAME_HUMAN)
TLHLERLAYLHARLREL

SEQ ID NO: 347553 - protein, 18 aa, Homo sapiens
  Native (PRAME_HUMAN)
TLHLERLAYLHARLRELL

SEQ ID NO: 347554 - protein, 19 aa, Homo sapiens
  Native (PRAME_HUMAN)
TLHLERLAYLHARLRELLC

SEQ ID NO: 347555 - protein, 20 aa, Homo sapiens
  Native (PRAME_HUMAN)
TLHLERLAYLHARLRELLCE

SEQ ID NO: 347556 - protein, 21 aa, Homo sapiens
  Native (PRAME_HUMAN)
TLHLERLAYLHARLRELLCEL

SEQ ID NO: 347557 - protein, 22 aa, Homo sapiens
  Native (PRAME_HUMAN)
TLHLERLAYLHARLRELLCELG

SEQ ID NO: 347558 - protein, 23 aa, Homo sapiens
  Native (PRAME_HUMAN)
TLHLERLAYLHARLRELLCELGR

SEQ ID NO: 347559 - protein, 24 aa, Homo sapiens
  Native (PRAME_HUMAN)
TLHLERLAYLHARLRELLCELGRP

SEQ ID NO: 347560 - protein, 25 aa, Homo sapiens
  Native (PRAME_HUMAN)
TLHLERLAYLHARLRELLCELGRPS

SEQ ID NO: 347561 - protein, 13 aa, Homo sapiens
  Native (PRAME_HUMAN)
TLKAMVQAWPFTC

SEQ ID NO: 347562 - protein, 14 aa, Homo sapiens
  Native (PRAME_HUMAN)
TLKAMVQAWPFTCL

SEQ ID NO: 347563 - protein, 15 aa, Homo sapiens
  Native (PRAME_HUMAN)
TLKAMVQAWPFTCLP

SEQ ID NO: 347564 - protein, 16 aa, Homo sapiens
  Native (PRAME_HUMAN)
TLKAMVQAWPFTCLPL

SEQ ID NO: 347565 - protein, 17 aa, Homo sapiens
  Native (PRAME_HUMAN)
TLKAMVQAWPFTCLPLG

SEQ ID NO: 347566 - protein, 18 aa, Homo sapiens
  Native (PRAME_HUMAN)
TLKAMVQAWPFTCLPLGV

SEQ ID NO: 347567 - protein, 19 aa, Homo sapiens
  Native (PRAME_HUMAN)
TLKAMVQAWPFTCLPLGVL

SEQ ID NO: 347568 - protein, 20 aa, Homo sapiens
  Native (PRAME_HUMAN)
TLKAMVQAWPFTCLPLGVLM

SEQ ID NO: 347569 - protein, 21 aa, Homo sapiens
  Native (PRAME_HUMAN)
TLKAMVQAWPFTCLPLGVLMK

SEQ ID NO: 347570 - protein, 22 aa, Homo sapiens
  Native (PRAME_HUMAN)
TLKAMVQAWPFTCLPLGVLMKG

SEQ ID NO: 347571 - protein, 23 aa, Homo sapiens
  Native (PRAME_HUMAN)
TLKAMVQAWPFTCLPLGVLMKGQ

SEQ ID NO: 347572 - protein, 24 aa, Homo sapiens
  Native (PRAME_HUMAN)
TLKAMVQAWPFTCLPLGVLMKGQH

SEQ ID NO: 347573 - protein, 25 aa, Homo sapiens
  Native (PRAME_HUMAN)
TLKAMVQAWPFTCLPLGVLMKGQHL

SEQ ID NO: 347574 - protein, 20 aa, Homo sapiens
  Native (PRAME_HUMAN)
TLQDLVFDECGITDDQLLAL

SEQ ID NO: 347575 - protein, 21 aa, Homo sapiens
  Native (PRAME_HUMAN)
TLQDLVFDECGITDDQLLALL

SEQ ID NO: 347576 - protein, 22 aa, Homo sapiens
  Native (PRAME_HUMAN)
TLQDLVFDECGITDDQLLALLP

SEQ ID NO: 347577 - protein, 23 aa, Homo sapiens
  Native (PRAME_HUMAN)
TLQDLVFDECGITDDQLLALLPS

SEQ ID NO: 347578 - protein, 24 aa, Homo sapiens
  Native (PRAME_HUMAN)
TLQDLVFDECGITDDQLLALLPSL

SEQ ID NO: 347579 - protein, 25 aa, Homo sapiens
  Native (PRAME_HUMAN)
TLQDLVFDECGITDDQLLALLPSLS

SEQ ID NO: 347580 - protein, 13 aa, Homo sapiens
  Native (PRAME_HUMAN)
TLSFYGNSISISA

SEQ ID NO: 347581 - protein, 14 aa, Homo sapiens
  Native (PRAME_HUMAN)
TLSFYGNSISISAL

SEQ ID NO: 347582 - protein, 15 aa, Homo sapiens
  Native (PRAME_HUMAN)
TLSFYGNSISISALQ

SEQ ID NO: 347583 - protein, 16 aa, Homo sapiens
  Native (PRAME_HUMAN)
TLSFYGNSISISALQS

SEQ ID NO: 347584 - protein, 17 aa, Homo sapiens
  Native (PRAME_HUMAN)
TLSFYGNSISISALQSL

SEQ ID NO: 347585 - protein, 18 aa, Homo sapiens
  Native (PRAME_HUMAN)
TLSFYGNSISISALQSLL

SEQ ID NO: 347586 - protein, 19 aa, Homo sapiens
  Native (PRAME_HUMAN)
TLSFYGNSISISALQSLLQ

SEQ ID NO: 347587 - protein, 20 aa, Homo sapiens
  Native (PRAME_HUMAN)
TLSFYGNSISISALQSLLQH

SEQ ID NO: 347588 - protein, 21 aa, Homo sapiens
  Native (PRAME_HUMAN)
TLSFYGNSISISALQSLLQHL

SEQ ID NO: 347589 - protein, 22 aa, Homo sapiens
  Native (PRAME_HUMAN)
TLSFYGNSISISALQSLLQHLI

SEQ ID NO: 347590 - protein, 23 aa, Homo sapiens
  Native (PRAME_HUMAN)
TLSFYGNSISISALQSLLQHLIG

SEQ ID NO: 347591 - protein, 24 aa, Homo sapiens
  Native (PRAME_HUMAN)
TLSFYGNSISISALQSLLQHLIGL

SEQ ID NO: 347592 - protein, 25 aa, Homo sapiens
  Native (PRAME_HUMAN)
TLSFYGNSISISALQSLLQHLIGLS

SEQ ID NO: 347593 - protein, 17 aa, Homo sapiens
  Native (PRAME_HUMAN)
TLSITNCRLSEGDVMHL

SEQ ID NO: 347594 - protein, 19 aa, Homo sapiens
  Native (PRAME_HUMAN)
TLSITNCRLSEGDVMHLSQ

SEQ ID NO: 347595 - protein, 20 aa, Homo sapiens
  Native (PRAME_HUMAN)
TLSITNCRLSEGDVMHLSQS

SEQ ID NO: 347596 - protein, 21 aa, Homo sapiens
  Native (PRAME_HUMAN)
TLSITNCRLSEGDVMHLSQSP

SEQ ID NO: 347597 - protein, 22 aa, Homo sapiens
  Native (PRAME_HUMAN)
TLSITNCRLSEGDVMHLSQSPS

SEQ ID NO: 347598 - protein, 23 aa, Homo sapiens
  Native (PRAME_HUMAN)
TLSITNCRLSEGDVMHLSQSPSV

SEQ ID NO: 347599 - protein, 24 aa, Homo sapiens
  Native (PRAME_HUMAN)
TLSITNCRLSEGDVMHLSQSPSVS

SEQ ID NO: 347600 - protein, 25 aa, Homo sapiens
  Native (PRAME_HUMAN)
TLSITNCRLSEGDVMHLSQSPSVSQ

SEQ ID NO: 347601 - protein, 15 aa, Homo sapiens
  Native (PRAME_HUMAN)
TNCRLSEGDVMHLSQ

SEQ ID NO: 347602 - protein, 19 aa, Homo sapiens
  Native (PRAME_HUMAN)
TNCRLSEGDVMHLSQSPSV

SEQ ID NO: 347603 - protein, 20 aa, Homo sapiens
  Native (PRAME_HUMAN)
TNCRLSEGDVMHLSQSPSVS

SEQ ID NO: 347604 - protein, 21 aa, Homo sapiens
  Native (PRAME_HUMAN)
TNCRLSEGDVMHLSQSPSVSQ

SEQ ID NO: 347605 - protein, 22 aa, Homo sapiens
  Native (PRAME_HUMAN)
TNCRLSEGDVMHLSQSPSVSQL

SEQ ID NO: 347606 - protein, 23 aa, Homo sapiens
  Native (PRAME_HUMAN)
TNCRLSEGDVMHLSQSPSVSQLS

SEQ ID NO: 347607 - protein, 24 aa, Homo sapiens
  Native (PRAME_HUMAN)
TNCRLSEGDVMHLSQSPSVSQLSV

SEQ ID NO: 347608 - protein, 25 aa, Homo sapiens
  Native (PRAME_HUMAN)
TNCRLSEGDVMHLSQSPSVSQLSVL

SEQ ID NO: 347609 - protein, 13 aa, Homo sapiens
  Native (PRAME_HUMAN)
TSPRRLVELAGQS

SEQ ID NO: 347610 - protein, 14 aa, Homo sapiens
  Native (PRAME_HUMAN)
TSPRRLVELAGQSL

SEQ ID NO: 347611 - protein, 15 aa, Homo sapiens
  Native (PRAME_HUMAN)
TSPRRLVELAGQSLL

SEQ ID NO: 347612 - protein, 16 aa, Homo sapiens
  Native (PRAME_HUMAN)
TSPRRLVELAGQSLLK

SEQ ID NO: 347613 - protein, 17 aa, Homo sapiens
  Native (PRAME_HUMAN)
TSPRRLVELAGQSLLKD

SEQ ID NO: 347614 - protein, 18 aa, Homo sapiens
  Native (PRAME_HUMAN)
TSPRRLVELAGQSLLKDE

SEQ ID NO: 347615 - protein, 19 aa, Homo sapiens
  Native (PRAME_HUMAN)
TSPRRLVELAGQSLLKDEA

SEQ ID NO: 347616 - protein, 20 aa, Homo sapiens
  Native (PRAME_HUMAN)
TSPRRLVELAGQSLLKDEAL

SEQ ID NO: 347617 - protein, 21 aa, Homo sapiens
  Native (PRAME_HUMAN)
TSPRRLVELAGQSLLKDEALA

SEQ ID NO: 347618 - protein, 22 aa, Homo sapiens
  Native (PRAME_HUMAN)
TSPRRLVELAGQSLLKDEALAI

SEQ ID NO: 347619 - protein, 23 aa, Homo sapiens
  Native (PRAME_HUMAN)
TSPRRLVELAGQSLLKDEALAIA

SEQ ID NO: 347620 - protein, 24 aa, Homo sapiens
  Native (PRAME_HUMAN)
TSPRRLVELAGQSLLKDEALAIAA

SEQ ID NO: 347621 - protein, 25 aa, Homo sapiens
  Native (PRAME_HUMAN)
TSPRRLVELAGQSLLKDEALAIAAL

SEQ ID NO: 347622 - protein, 13 aa, Homo sapiens
  Native (PRAME_HUMAN)
TSQFLSLQCLQAL

SEQ ID NO: 347623 - protein, 14 aa, Homo sapiens
  Native (PRAME_HUMAN)
TSQFLSLQCLQALY

SEQ ID NO: 347624 - protein, 15 aa, Homo sapiens
  Native (PRAME_HUMAN)
TSQFLSLQCLQALYV

SEQ ID NO: 347625 - protein, 16 aa, Homo sapiens
  Native (PRAME_HUMAN)
TSQFLSLQCLQALYVD

SEQ ID NO: 347626 - protein, 17 aa, Homo sapiens
  Native (PRAME_HUMAN)
TSQFLSLQCLQALYVDS

SEQ ID NO: 347627 - protein, 18 aa, Homo sapiens
  Native (PRAME_HUMAN)
TSQFLSLQCLQALYVDSL

SEQ ID NO: 347628 - protein, 20 aa, Homo sapiens
  Native (PRAME_HUMAN)
TSQFLSLQCLQALYVDSLFF

SEQ ID NO: 347629 - protein, 21 aa, Homo sapiens
  Native (PRAME_HUMAN)
TSQFLSLQCLQALYVDSLFFL

SEQ ID NO: 347630 - protein, 22 aa, Homo sapiens
  Native (PRAME_HUMAN)
TSQFLSLQCLQALYVDSLFFLR

SEQ ID NO: 347631 - protein, 23 aa, Homo sapiens
  Native (PRAME_HUMAN)
TSQFLSLQCLQALYVDSLFFLRG

SEQ ID NO: 347632 - protein, 24 aa, Homo sapiens
  Native (PRAME_HUMAN)
TSQFLSLQCLQALYVDSLFFLRGR

SEQ ID NO: 347633 - protein, 25 aa, Homo sapiens
  Native (PRAME_HUMAN)
TSQFLSLQCLQALYVDSLFFLRGRL

SEQ ID NO: 347634 - protein, 13 aa, Homo sapiens
  Native (PRAME_HUMAN)
TTLSFYGNSISIS

SEQ ID NO: 347635 - protein, 14 aa, Homo sapiens
  Native (PRAME_HUMAN)
TTLSFYGNSISISA

SEQ ID NO: 347636 - protein, 15 aa, Homo sapiens
  Native (PRAME_HUMAN)
TTLSFYGNSISISAL

SEQ ID NO: 347637 - protein, 16 aa, Homo sapiens
  Native (PRAME_HUMAN)
TTLSFYGNSISISALQ

SEQ ID NO: 347638 - protein, 17 aa, Homo sapiens
  Native (PRAME_HUMAN)
TTLSFYGNSISISALQS

SEQ ID NO: 347639 - protein, 18 aa, Homo sapiens
  Native (PRAME_HUMAN)
TTLSFYGNSISISALQSL

SEQ ID NO: 347640 - protein, 19 aa, Homo sapiens
  Native (PRAME_HUMAN)
TTLSFYGNSISISALQSLL

SEQ ID NO: 347641 - protein, 20 aa, Homo sapiens
  Native (PRAME_HUMAN)
TTLSFYGNSISISALQSLLQ

SEQ ID NO: 347642 - protein, 21 aa, Homo sapiens
  Native (PRAME_HUMAN)
TTLSFYGNSISISALQSLLQH

SEQ ID NO: 347643 - protein, 22 aa, Homo sapiens
  Native (PRAME_HUMAN)
TTLSFYGNSISISALQSLLQHL

SEQ ID NO: 347644 - protein, 23 aa, Homo sapiens
  Native (PRAME_HUMAN)
TTLSFYGNSISISALQSLLQHLI

SEQ ID NO: 347645 - protein, 24 aa, Homo sapiens
  Native (PRAME_HUMAN)
TTLSFYGNSISISALQSLLQHLIG

SEQ ID NO: 347646 - protein, 25 aa, Homo sapiens
  Native (PRAME_HUMAN)
TTLSFYGNSISISALQSLLQHLIGL

SEQ ID NO: 347647 - protein, 13 aa, Homo sapiens
  Native (PRAME_HUMAN)
TVWSGNRASLYSF

SEQ ID NO: 347648 - protein, 14 aa, Homo sapiens
  Native (PRAME_HUMAN)
TVWSGNRASLYSFP

SEQ ID NO: 347649 - protein, 15 aa, Homo sapiens
  Native (PRAME_HUMAN)
TVWSGNRASLYSFPE

SEQ ID NO: 347650 - protein, 16 aa, Homo sapiens
  Native (PRAME_HUMAN)
TVWSGNRASLYSFPEP

SEQ ID NO: 347651 - protein, 17 aa, Homo sapiens
  Native (PRAME_HUMAN)
TVWSGNRASLYSFPEPE

SEQ ID NO: 347652 - protein, 18 aa, Homo sapiens
  Native (PRAME_HUMAN)
TVWSGNRASLYSFPEPEA

SEQ ID NO: 347653 - protein, 19 aa, Homo sapiens
  Native (PRAME_HUMAN)
TVWSGNRASLYSFPEPEAA

SEQ ID NO: 347654 - protein, 20 aa, Homo sapiens
  Native (PRAME_HUMAN)
TVWSGNRASLYSFPEPEAAQ

SEQ ID NO: 347655 - protein, 21 aa, Homo sapiens
  Native (PRAME_HUMAN)
TVWSGNRASLYSFPEPEAAQP

SEQ ID NO: 347656 - protein, 22 aa, Homo sapiens
  Native (PRAME_HUMAN)
TVWSGNRASLYSFPEPEAAQPM

SEQ ID NO: 347657 - protein, 23 aa, Homo sapiens
  Native (PRAME_HUMAN)
TVWSGNRASLYSFPEPEAAQPMT

SEQ ID NO: 347658 - protein, 24 aa, Homo sapiens
  Native (PRAME_HUMAN)
TVWSGNRASLYSFPEPEAAQPMTK

SEQ ID NO: 347659 - protein, 25 aa, Homo sapiens
  Native (PRAME_HUMAN)
TVWSGNRASLYSFPEPEAAQPMTKK

SEQ ID NO: 347660 - protein, 14 aa, Homo sapiens
  Native (PRAME_HUMAN)
TWKLPTLAKFSPYL

SEQ ID NO: 347661 - protein, 15 aa, Homo sapiens
  Native (PRAME_HUMAN)
TWKLPTLAKFSPYLG

SEQ ID NO: 347662 - protein, 16 aa, Homo sapiens
  Native (PRAME_HUMAN)
TWKLPTLAKFSPYLGQ

SEQ ID NO: 347663 - protein, 17 aa, Homo sapiens
  Native (PRAME_HUMAN)
TWKLPTLAKFSPYLGQM

SEQ ID NO: 347664 - protein, 18 aa, Homo sapiens
  Native (PRAME_HUMAN)
TWKLPTLAKFSPYLGQMI

SEQ ID NO: 347665 - protein, 19 aa, Homo sapiens
  Native (PRAME_HUMAN)
TWKLPTLAKFSPYLGQMIN

SEQ ID NO: 347666 - protein, 20 aa, Homo sapiens
  Native (PRAME_HUMAN)
TWKLPTLAKFSPYLGQMINL

SEQ ID NO: 347667 - protein, 21 aa, Homo sapiens
  Native (PRAME_HUMAN)
TWKLPTLAKFSPYLGQMINLR

SEQ ID NO: 347668 - protein, 22 aa, Homo sapiens
  Native (PRAME_HUMAN)
TWKLPTLAKFSPYLGQMINLRR

SEQ ID NO: 347669 - protein, 23 aa, Homo sapiens
  Native (PRAME_HUMAN)
TWKLPTLAKFSPYLGQMINLRRL

SEQ ID NO: 347670 - protein, 24 aa, Homo sapiens
  Native (PRAME_HUMAN)
TWKLPTLAKFSPYLGQMINLRRLL

SEQ ID NO: 347671 - protein, 25 aa, Homo sapiens
  Native (PRAME_HUMAN)
TWKLPTLAKFSPYLGQMINLRRLLL

SEQ ID NO: 347672 - protein, 13 aa, Homo sapiens
  Native (PRAME_HUMAN)
VDGLSTEAEQPFI

SEQ ID NO: 347673 - protein, 14 aa, Homo sapiens
  Native (PRAME_HUMAN)
VDGLSTEAEQPFIP

SEQ ID NO: 347674 - protein, 15 aa, Homo sapiens
  Native (PRAME_HUMAN)
VDGLSTEAEQPFIPV

SEQ ID NO: 347675 - protein, 16 aa, Homo sapiens
  Native (PRAME_HUMAN)
VDGLSTEAEQPFIPVE

SEQ ID NO: 347676 - protein, 17 aa, Homo sapiens
  Native (PRAME_HUMAN)
VDGLSTEAEQPFIPVEV

SEQ ID NO: 347677 - protein, 18 aa, Homo sapiens
  Native (PRAME_HUMAN)
VDGLSTEAEQPFIPVEVL

SEQ ID NO: 347678 - protein, 19 aa, Homo sapiens
  Native (PRAME_HUMAN)
VDGLSTEAEQPFIPVEVLV

SEQ ID NO: 347679 - protein, 20 aa, Homo sapiens
  Native (PRAME_HUMAN)
VDGLSTEAEQPFIPVEVLVD

SEQ ID NO: 347680 - protein, 21 aa, Homo sapiens
  Native (PRAME_HUMAN)
VDGLSTEAEQPFIPVEVLVDL

SEQ ID NO: 347681 - protein, 22 aa, Homo sapiens
  Native (PRAME_HUMAN)
VDGLSTEAEQPFIPVEVLVDLF

SEQ ID NO: 347682 - protein, 23 aa, Homo sapiens
  Native (PRAME_HUMAN)
VDGLSTEAEQPFIPVEVLVDLFL

SEQ ID NO: 347683 - protein, 24 aa, Homo sapiens
  Native (PRAME_HUMAN)
VDGLSTEAEQPFIPVEVLVDLFLK

SEQ ID NO: 347684 - protein, 25 aa, Homo sapiens
  Native (PRAME_HUMAN)
VDGLSTEAEQPFIPVEVLVDLFLKE

SEQ ID NO: 347685 - protein, 14 aa, Homo sapiens
  Native (PRAME_HUMAN)
VDLFLKEGACDELF

SEQ ID NO: 347686 - protein, 15 aa, Homo sapiens
  Native (PRAME_HUMAN)
VDLFLKEGACDELFS

SEQ ID NO: 347687 - protein, 16 aa, Homo sapiens
  Native (PRAME_HUMAN)
VDLFLKEGACDELFSY

SEQ ID NO: 347688 - protein, 17 aa, Homo sapiens
  Native (PRAME_HUMAN)
VDLFLKEGACDELFSYL

SEQ ID NO: 347689 - protein, 19 aa, Homo sapiens
  Native (PRAME_HUMAN)
VDLFLKEGACDELFSYLIE

SEQ ID NO: 347690 - protein, 20 aa, Homo sapiens
  Native (PRAME_HUMAN)
VDLFLKEGACDELFSYLIEK

SEQ ID NO: 347691 - protein, 21 aa, Homo sapiens
  Native (PRAME_HUMAN)
VDLFLKEGACDELFSYLIEKV

SEQ ID NO: 347692 - protein, 22 aa, Homo sapiens
  Native (PRAME_HUMAN)
VDLFLKEGACDELFSYLIEKVK

SEQ ID NO: 347693 - protein, 23 aa, Homo sapiens
  Native (PRAME_HUMAN)
VDLFLKEGACDELFSYLIEKVKR

SEQ ID NO: 347694 - protein, 24 aa, Homo sapiens
  Native (PRAME_HUMAN)
VDLFLKEGACDELFSYLIEKVKRK

SEQ ID NO: 347695 - protein, 25 aa, Homo sapiens
  Native (PRAME_HUMAN)
VDLFLKEGACDELFSYLIEKVKRKK

SEQ ID NO: 347696 - protein, 13 aa, Homo sapiens
  Native (PRAME_HUMAN)
VDSLFFLRGRLDQ

SEQ ID NO: 347697 - protein, 14 aa, Homo sapiens
  Native (PRAME_HUMAN)
VDSLFFLRGRLDQL

SEQ ID NO: 347698 - protein, 15 aa, Homo sapiens
  Native (PRAME_HUMAN)
VDSLFFLRGRLDQLL

SEQ ID NO: 347699 - protein, 16 aa, Homo sapiens
  Native (PRAME_HUMAN)
VDSLFFLRGRLDQLLR

SEQ ID NO: 347700 - protein, 17 aa, Homo sapiens
  Native (PRAME_HUMAN)
VDSLFFLRGRLDQLLRH

SEQ ID NO: 347701 - protein, 18 aa, Homo sapiens
  Native (PRAME_HUMAN)
VDSLFFLRGRLDQLLRHV

SEQ ID NO: 347702 - protein, 19 aa, Homo sapiens
  Native (PRAME_HUMAN)
VDSLFFLRGRLDQLLRHVM

SEQ ID NO: 347703 - protein, 20 aa, Homo sapiens
  Native (PRAME_HUMAN)
VDSLFFLRGRLDQLLRHVMN

SEQ ID NO: 347704 - protein, 21 aa, Homo sapiens
  Native (PRAME_HUMAN)
VDSLFFLRGRLDQLLRHVMNP

SEQ ID NO: 347705 - protein, 22 aa, Homo sapiens
  Native (PRAME_HUMAN)
VDSLFFLRGRLDQLLRHVMNPL

SEQ ID NO: 347706 - protein, 23 aa, Homo sapiens
  Native (PRAME_HUMAN)
VDSLFFLRGRLDQLLRHVMNPLE

SEQ ID NO: 347707 - protein, 24 aa, Homo sapiens
  Native (PRAME_HUMAN)
VDSLFFLRGRLDQLLRHVMNPLET

SEQ ID NO: 347708 - protein, 25 aa, Homo sapiens
  Native (PRAME_HUMAN)
VDSLFFLRGRLDQLLRHVMNPLETL

SEQ ID NO: 347709 - protein, 13 aa, Homo sapiens
  Native (PRAME_HUMAN)
VELAGQSLLKDEA

SEQ ID NO: 347710 - protein, 14 aa, Homo sapiens
  Native (PRAME_HUMAN)
VELAGQSLLKDEAL

SEQ ID NO: 347711 - protein, 15 aa, Homo sapiens
  Native (PRAME_HUMAN)
VELAGQSLLKDEALA

SEQ ID NO: 347712 - protein, 16 aa, Homo sapiens
  Native (PRAME_HUMAN)
VELAGQSLLKDEALAI

SEQ ID NO: 347713 - protein, 17 aa, Homo sapiens
  Native (PRAME_HUMAN)
VELAGQSLLKDEALAIA

SEQ ID NO: 347714 - protein, 18 aa, Homo sapiens
  Native (PRAME_HUMAN)
VELAGQSLLKDEALAIAA

SEQ ID NO: 347715 - protein, 19 aa, Homo sapiens
  Native (PRAME_HUMAN)
VELAGQSLLKDEALAIAAL

SEQ ID NO: 347716 - protein, 20 aa, Homo sapiens
  Native (PRAME_HUMAN)
VELAGQSLLKDEALAIAALE

SEQ ID NO: 347717 - protein, 21 aa, Homo sapiens
  Native (PRAME_HUMAN)
VELAGQSLLKDEALAIAALEL

SEQ ID NO: 347718 - protein, 22 aa, Homo sapiens
  Native (PRAME_HUMAN)
VELAGQSLLKDEALAIAALELL

SEQ ID NO: 347719 - protein, 23 aa, Homo sapiens
  Native (PRAME_HUMAN)
VELAGQSLLKDEALAIAALELLP

SEQ ID NO: 347720 - protein, 24 aa, Homo sapiens
  Native (PRAME_HUMAN)
VELAGQSLLKDEALAIAALELLPR

SEQ ID NO: 347721 - protein, 25 aa, Homo sapiens
  Native (PRAME_HUMAN)
VELAGQSLLKDEALAIAALELLPRE

SEQ ID NO: 347722 - protein, 13 aa, Homo sapiens
  Native (PRAME_HUMAN)
VEVLVDLFLKEGA

SEQ ID NO: 347723 - protein, 14 aa, Homo sapiens
  Native (PRAME_HUMAN)
VEVLVDLFLKEGAC

SEQ ID NO: 347724 - protein, 15 aa, Homo sapiens
  Native (PRAME_HUMAN)
VEVLVDLFLKEGACD

SEQ ID NO: 347725 - protein, 16 aa, Homo sapiens
  Native (PRAME_HUMAN)
VEVLVDLFLKEGACDE

SEQ ID NO: 347726 - protein, 17 aa, Homo sapiens
  Native (PRAME_HUMAN)
VEVLVDLFLKEGACDEL

SEQ ID NO: 347727 - protein, 18 aa, Homo sapiens
  Native (PRAME_HUMAN)
VEVLVDLFLKEGACDELF

SEQ ID NO: 347728 - protein, 19 aa, Homo sapiens
  Native (PRAME_HUMAN)
VEVLVDLFLKEGACDELFS

SEQ ID NO: 347729 - protein, 20 aa, Homo sapiens
  Native (PRAME_HUMAN)
VEVLVDLFLKEGACDELFSY

SEQ ID NO: 347730 - protein, 21 aa, Homo sapiens
  Native (PRAME_HUMAN)
VEVLVDLFLKEGACDELFSYL

SEQ ID NO: 347731 - protein, 22 aa, Homo sapiens
  Native (PRAME_HUMAN)
VEVLVDLFLKEGACDELFSYLI

SEQ ID NO: 347732 - protein, 23 aa, Homo sapiens
  Native (PRAME_HUMAN)
VEVLVDLFLKEGACDELFSYLIE

SEQ ID NO: 347733 - protein, 24 aa, Homo sapiens
  Native (PRAME_HUMAN)
VEVLVDLFLKEGACDELFSYLIEK

SEQ ID NO: 347734 - protein, 25 aa, Homo sapiens
  Native (PRAME_HUMAN)
VEVLVDLFLKEGACDELFSYLIEKV

SEQ ID NO: 347735 - protein, 15 aa, Homo sapiens
  Native (PRAME_HUMAN)
VFDECGITDDQLLAL

SEQ ID NO: 347736 - protein, 16 aa, Homo sapiens
  Native (PRAME_HUMAN)
VFDECGITDDQLLALL

SEQ ID NO: 347737 - protein, 17 aa, Homo sapiens
  Native (PRAME_HUMAN)
VFDECGITDDQLLALLP

SEQ ID NO: 347738 - protein, 18 aa, Homo sapiens
  Native (PRAME_HUMAN)
VFDECGITDDQLLALLPS

SEQ ID NO: 347739 - protein, 19 aa, Homo sapiens
  Native (PRAME_HUMAN)
VFDECGITDDQLLALLPSL

SEQ ID NO: 347740 - protein, 20 aa, Homo sapiens
  Native (PRAME_HUMAN)
VFDECGITDDQLLALLPSLS

SEQ ID NO: 347741 - protein, 21 aa, Homo sapiens
  Native (PRAME_HUMAN)
VFDECGITDDQLLALLPSLSH

SEQ ID NO: 347742 - protein, 22 aa, Homo sapiens
  Native (PRAME_HUMAN)
VFDECGITDDQLLALLPSLSHC

SEQ ID NO: 347743 - protein, 23 aa, Homo sapiens
  Native (PRAME_HUMAN)
VFDECGITDDQLLALLPSLSHCS

SEQ ID NO: 347744 - protein, 24 aa, Homo sapiens
  Native (PRAME_HUMAN)
VFDECGITDDQLLALLPSLSHCSQ

SEQ ID NO: 347745 - protein, 25 aa, Homo sapiens
  Native (PRAME_HUMAN)
VFDECGITDDQLLALLPSLSHCSQL

SEQ ID NO: 347746 - protein, 14 aa, Homo sapiens
  Native (PRAME_HUMAN)
VKRKKNVLRLCCKK

SEQ ID NO: 347747 - protein, 15 aa, Homo sapiens
  Native (PRAME_HUMAN)
VKRKKNVLRLCCKKL

SEQ ID NO: 347748 - protein, 16 aa, Homo sapiens
  Native (PRAME_HUMAN)
VKRKKNVLRLCCKKLK

SEQ ID NO: 347749 - protein, 17 aa, Homo sapiens
  Native (PRAME_HUMAN)
VKRKKNVLRLCCKKLKI

SEQ ID NO: 347750 - protein, 18 aa, Homo sapiens
  Native (PRAME_HUMAN)
VKRKKNVLRLCCKKLKIF

SEQ ID NO: 347751 - protein, 19 aa, Homo sapiens
  Native (PRAME_HUMAN)
VKRKKNVLRLCCKKLKIFA

SEQ ID NO: 347752 - protein, 20 aa, Homo sapiens
  Native (PRAME_HUMAN)
VKRKKNVLRLCCKKLKIFAM

SEQ ID NO: 347753 - protein, 21 aa, Homo sapiens
  Native (PRAME_HUMAN)
VKRKKNVLRLCCKKLKIFAMP

SEQ ID NO: 347754 - protein, 22 aa, Homo sapiens
  Native (PRAME_HUMAN)
VKRKKNVLRLCCKKLKIFAMPM

SEQ ID NO: 347755 - protein, 23 aa, Homo sapiens
  Native (PRAME_HUMAN)
VKRKKNVLRLCCKKLKIFAMPMQ

SEQ ID NO: 347756 - protein, 24 aa, Homo sapiens
  Native (PRAME_HUMAN)
VKRKKNVLRLCCKKLKIFAMPMQD

SEQ ID NO: 347757 - protein, 25 aa, Homo sapiens
  Native (PRAME_HUMAN)
VKRKKNVLRLCCKKLKIFAMPMQDI

SEQ ID NO: 347758 - protein, 13 aa, Homo sapiens
  Native (PRAME_HUMAN)
VLDGLDVLLAQEV

SEQ ID NO: 347759 - protein, 14 aa, Homo sapiens
  Native (PRAME_HUMAN)
VLDGLDVLLAQEVR

SEQ ID NO: 347760 - protein, 15 aa, Homo sapiens
  Native (PRAME_HUMAN)
VLDGLDVLLAQEVRP

SEQ ID NO: 347761 - protein, 16 aa, Homo sapiens
  Native (PRAME_HUMAN)
VLDGLDVLLAQEVRPR

SEQ ID NO: 347762 - protein, 17 aa, Homo sapiens
  Native (PRAME_HUMAN)
VLDGLDVLLAQEVRPRR

SEQ ID NO: 347763 - protein, 18 aa, Homo sapiens
  Native (PRAME_HUMAN)
VLDGLDVLLAQEVRPRRW

SEQ ID NO: 347764 - protein, 19 aa, Homo sapiens
  Native (PRAME_HUMAN)
VLDGLDVLLAQEVRPRRWK

SEQ ID NO: 347765 - protein, 20 aa, Homo sapiens
  Native (PRAME_HUMAN)
VLDGLDVLLAQEVRPRRWKL

SEQ ID NO: 347766 - protein, 21 aa, Homo sapiens
  Native (PRAME_HUMAN)
VLDGLDVLLAQEVRPRRWKLQ

SEQ ID NO: 347767 - protein, 22 aa, Homo sapiens
  Native (PRAME_HUMAN)
VLDGLDVLLAQEVRPRRWKLQV

SEQ ID NO: 347768 - protein, 23 aa, Homo sapiens
  Native (PRAME_HUMAN)
VLDGLDVLLAQEVRPRRWKLQVL

SEQ ID NO: 347769 - protein, 24 aa, Homo sapiens
  Native (PRAME_HUMAN)
VLDGLDVLLAQEVRPRRWKLQVLD

SEQ ID NO: 347770 - protein, 25 aa, Homo sapiens
  Native (PRAME_HUMAN)
VLDGLDVLLAQEVRPRRWKLQVLDL

SEQ ID NO: 347771 - protein, 13 aa, Homo sapiens
  Native (PRAME_HUMAN)
VLDLRKNSHQDFW

SEQ ID NO: 347772 - protein, 14 aa, Homo sapiens
  Native (PRAME_HUMAN)
VLDLRKNSHQDFWT

SEQ ID NO: 347773 - protein, 15 aa, Homo sapiens
  Native (PRAME_HUMAN)
VLDLRKNSHQDFWTV

SEQ ID NO: 347774 - protein, 16 aa, Homo sapiens
  Native (PRAME_HUMAN)
VLDLRKNSHQDFWTVW

SEQ ID NO: 347775 - protein, 17 aa, Homo sapiens
  Native (PRAME_HUMAN)
VLDLRKNSHQDFWTVWS

SEQ ID NO: 347776 - protein, 18 aa, Homo sapiens
  Native (PRAME_HUMAN)
VLDLRKNSHQDFWTVWSG

SEQ ID NO: 347777 - protein, 19 aa, Homo sapiens
  Native (PRAME_HUMAN)
VLDLRKNSHQDFWTVWSGN

SEQ ID NO: 347778 - protein, 20 aa, Homo sapiens
  Native (PRAME_HUMAN)
VLDLRKNSHQDFWTVWSGNR

SEQ ID NO: 347779 - protein, 21 aa, Homo sapiens
  Native (PRAME_HUMAN)
VLDLRKNSHQDFWTVWSGNRA

SEQ ID NO: 347780 - protein, 22 aa, Homo sapiens
  Native (PRAME_HUMAN)
VLDLRKNSHQDFWTVWSGNRAS

SEQ ID NO: 347781 - protein, 23 aa, Homo sapiens
  Native (PRAME_HUMAN)
VLDLRKNSHQDFWTVWSGNRASL

SEQ ID NO: 347782 - protein, 24 aa, Homo sapiens
  Native (PRAME_HUMAN)
VLDLRKNSHQDFWTVWSGNRASLY

SEQ ID NO: 347783 - protein, 25 aa, Homo sapiens
  Native (PRAME_HUMAN)
VLDLRKNSHQDFWTVWSGNRASLYS

SEQ ID NO: 347784 - protein, 14 aa, Homo sapiens
  Native (PRAME_HUMAN)
VLLAQEVRPRRWKL

SEQ ID NO: 347785 - protein, 15 aa, Homo sapiens
  Native (PRAME_HUMAN)
VLLAQEVRPRRWKLQ

SEQ ID NO: 347786 - protein, 16 aa, Homo sapiens
  Native (PRAME_HUMAN)
VLLAQEVRPRRWKLQV

SEQ ID NO: 347787 - protein, 17 aa, Homo sapiens
  Native (PRAME_HUMAN)
VLLAQEVRPRRWKLQVL

SEQ ID NO: 347788 - protein, 18 aa, Homo sapiens
  Native (PRAME_HUMAN)
VLLAQEVRPRRWKLQVLD

SEQ ID NO: 347789 - protein, 19 aa, Homo sapiens
  Native (PRAME_HUMAN)
VLLAQEVRPRRWKLQVLDL

SEQ ID NO: 347790 - protein, 20 aa, Homo sapiens
  Native (PRAME_HUMAN)
VLLAQEVRPRRWKLQVLDLR

SEQ ID NO: 347791 - protein, 21 aa, Homo sapiens
  Native (PRAME_HUMAN)
VLLAQEVRPRRWKLQVLDLRK

SEQ ID NO: 347792 - protein, 22 aa, Homo sapiens
  Native (PRAME_HUMAN)
VLLAQEVRPRRWKLQVLDLRKN

SEQ ID NO: 347793 - protein, 23 aa, Homo sapiens
  Native (PRAME_HUMAN)
VLLAQEVRPRRWKLQVLDLRKNS

SEQ ID NO: 347794 - protein, 24 aa, Homo sapiens
  Native (PRAME_HUMAN)
VLLAQEVRPRRWKLQVLDLRKNSH

SEQ ID NO: 347795 - protein, 25 aa, Homo sapiens
  Native (PRAME_HUMAN)
VLLAQEVRPRRWKLQVLDLRKNSHQ

SEQ ID NO: 347796 - protein, 14 aa, Homo sapiens
  Native (PRAME_HUMAN)
VLMKGQHLHLETFK

SEQ ID NO: 347797 - protein, 15 aa, Homo sapiens
  Native (PRAME_HUMAN)
VLMKGQHLHLETFKA

SEQ ID NO: 347798 - protein, 16 aa, Homo sapiens
  Native (PRAME_HUMAN)
VLMKGQHLHLETFKAV

SEQ ID NO: 347799 - protein, 17 aa, Homo sapiens
  Native (PRAME_HUMAN)
VLMKGQHLHLETFKAVL

SEQ ID NO: 347800 - protein, 18 aa, Homo sapiens
  Native (PRAME_HUMAN)
VLMKGQHLHLETFKAVLD

SEQ ID NO: 347801 - protein, 19 aa, Homo sapiens
  Native (PRAME_HUMAN)
VLMKGQHLHLETFKAVLDG

SEQ ID NO: 347802 - protein, 20 aa, Homo sapiens
  Native (PRAME_HUMAN)
VLMKGQHLHLETFKAVLDGL

SEQ ID NO: 347803 - protein, 21 aa, Homo sapiens
  Native (PRAME_HUMAN)
VLMKGQHLHLETFKAVLDGLD

SEQ ID NO: 347804 - protein, 22 aa, Homo sapiens
  Native (PRAME_HUMAN)
VLMKGQHLHLETFKAVLDGLDV

SEQ ID NO: 347805 - protein, 23 aa, Homo sapiens
  Native (PRAME_HUMAN)
VLMKGQHLHLETFKAVLDGLDVL

SEQ ID NO: 347806 - protein, 24 aa, Homo sapiens
  Native (PRAME_HUMAN)
VLMKGQHLHLETFKAVLDGLDVLL

SEQ ID NO: 347807 - protein, 25 aa, Homo sapiens
  Native (PRAME_HUMAN)
VLMKGQHLHLETFKAVLDGLDVLLA

SEQ ID NO: 347808 - protein, 13 aa, Homo sapiens
  Native (PRAME_HUMAN)
VLRLCCKKLKIFA

SEQ ID NO: 347809 - protein, 14 aa, Homo sapiens
  Native (PRAME_HUMAN)
VLRLCCKKLKIFAM

SEQ ID NO: 347810 - protein, 15 aa, Homo sapiens
  Native (PRAME_HUMAN)
VLRLCCKKLKIFAMP

SEQ ID NO: 347811 - protein, 16 aa, Homo sapiens
  Native (PRAME_HUMAN)
VLRLCCKKLKIFAMPM

SEQ ID NO: 347812 - protein, 17 aa, Homo sapiens
  Native (PRAME_HUMAN)
VLRLCCKKLKIFAMPMQ

SEQ ID NO: 347813 - protein, 18 aa, Homo sapiens
  Native (PRAME_HUMAN)
VLRLCCKKLKIFAMPMQD

SEQ ID NO: 347814 - protein, 19 aa, Homo sapiens
  Native (PRAME_HUMAN)
VLRLCCKKLKIFAMPMQDI

SEQ ID NO: 347815 - protein, 20 aa, Homo sapiens
  Native (PRAME_HUMAN)
VLRLCCKKLKIFAMPMQDIK

SEQ ID NO: 347816 - protein, 21 aa, Homo sapiens
  Native (PRAME_HUMAN)
VLRLCCKKLKIFAMPMQDIKM

SEQ ID NO: 347817 - protein, 22 aa, Homo sapiens
  Native (PRAME_HUMAN)
VLRLCCKKLKIFAMPMQDIKMI

SEQ ID NO: 347818 - protein, 23 aa, Homo sapiens
  Native (PRAME_HUMAN)
VLRLCCKKLKIFAMPMQDIKMIL

SEQ ID NO: 347819 - protein, 24 aa, Homo sapiens
  Native (PRAME_HUMAN)
VLRLCCKKLKIFAMPMQDIKMILK

SEQ ID NO: 347820 - protein, 25 aa, Homo sapiens
  Native (PRAME_HUMAN)
VLRLCCKKLKIFAMPMQDIKMILKM

SEQ ID NO: 347821 - protein, 13 aa, Homo sapiens
  Native (PRAME_HUMAN)
VLSLSGVMLTDVS

SEQ ID NO: 347822 - protein, 14 aa, Homo sapiens
  Native (PRAME_HUMAN)
VLSLSGVMLTDVSP

SEQ ID NO: 347823 - protein, 15 aa, Homo sapiens
  Native (PRAME_HUMAN)
VLSLSGVMLTDVSPE

SEQ ID NO: 347824 - protein, 16 aa, Homo sapiens
  Native (PRAME_HUMAN)
VLSLSGVMLTDVSPEP

SEQ ID NO: 347825 - protein, 17 aa, Homo sapiens
  Native (PRAME_HUMAN)
VLSLSGVMLTDVSPEPL

SEQ ID NO: 347826 - protein, 18 aa, Homo sapiens
  Native (PRAME_HUMAN)
VLSLSGVMLTDVSPEPLQ

SEQ ID NO: 347827 - protein, 19 aa, Homo sapiens
  Native (PRAME_HUMAN)
VLSLSGVMLTDVSPEPLQA

SEQ ID NO: 347828 - protein, 20 aa, Homo sapiens
  Native (PRAME_HUMAN)
VLSLSGVMLTDVSPEPLQAL

SEQ ID NO: 347829 - protein, 21 aa, Homo sapiens
  Native (PRAME_HUMAN)
VLSLSGVMLTDVSPEPLQALL

SEQ ID NO: 347830 - protein, 22 aa, Homo sapiens
  Native (PRAME_HUMAN)
VLSLSGVMLTDVSPEPLQALLE

SEQ ID NO: 347831 - protein, 23 aa, Homo sapiens
  Native (PRAME_HUMAN)
VLSLSGVMLTDVSPEPLQALLER

SEQ ID NO: 347832 - protein, 24 aa, Homo sapiens
  Native (PRAME_HUMAN)
VLSLSGVMLTDVSPEPLQALLERA

SEQ ID NO: 347833 - protein, 25 aa, Homo sapiens
  Native (PRAME_HUMAN)
VLSLSGVMLTDVSPEPLQALLERAS

SEQ ID NO: 347834 - protein, 14 aa, Homo sapiens
  Native (PRAME_HUMAN)
VLVDLFLKEGACDE

SEQ ID NO: 347835 - protein, 15 aa, Homo sapiens
  Native (PRAME_HUMAN)
VLVDLFLKEGACDEL

SEQ ID NO: 347836 - protein, 16 aa, Homo sapiens
  Native (PRAME_HUMAN)
VLVDLFLKEGACDELF

SEQ ID NO: 347837 - protein, 17 aa, Homo sapiens
  Native (PRAME_HUMAN)
VLVDLFLKEGACDELFS

SEQ ID NO: 347838 - protein, 18 aa, Homo sapiens
  Native (PRAME_HUMAN)
VLVDLFLKEGACDELFSY

SEQ ID NO: 347839 - protein, 19 aa, Homo sapiens
  Native (PRAME_HUMAN)
VLVDLFLKEGACDELFSYL

SEQ ID NO: 347840 - protein, 20 aa, Homo sapiens
  Native (PRAME_HUMAN)
VLVDLFLKEGACDELFSYLI

SEQ ID NO: 347841 - protein, 21 aa, Homo sapiens
  Native (PRAME_HUMAN)
VLVDLFLKEGACDELFSYLIE

SEQ ID NO: 347842 - protein, 22 aa, Homo sapiens
  Native (PRAME_HUMAN)
VLVDLFLKEGACDELFSYLIEK

SEQ ID NO: 347843 - protein, 23 aa, Homo sapiens
  Native (PRAME_HUMAN)
VLVDLFLKEGACDELFSYLIEKV

SEQ ID NO: 347844 - protein, 24 aa, Homo sapiens
  Native (PRAME_HUMAN)
VLVDLFLKEGACDELFSYLIEKVK

SEQ ID NO: 347845 - protein, 13 aa, Homo sapiens
  Native (PRAME_HUMAN)
VLYPVPLESYEDI

SEQ ID NO: 347846 - protein, 14 aa, Homo sapiens
  Native (PRAME_HUMAN)
VLYPVPLESYEDIH

SEQ ID NO: 347847 - protein, 15 aa, Homo sapiens
  Native (PRAME_HUMAN)
VLYPVPLESYEDIHG

SEQ ID NO: 347848 - protein, 16 aa, Homo sapiens
  Native (PRAME_HUMAN)
VLYPVPLESYEDIHGT

SEQ ID NO: 347849 - protein, 17 aa, Homo sapiens
  Native (PRAME_HUMAN)
VLYPVPLESYEDIHGTL

SEQ ID NO: 347850 - protein, 18 aa, Homo sapiens
  Native (PRAME_HUMAN)
VLYPVPLESYEDIHGTLH

SEQ ID NO: 347851 - protein, 19 aa, Homo sapiens
  Native (PRAME_HUMAN)
VLYPVPLESYEDIHGTLHL

SEQ ID NO: 347852 - protein, 20 aa, Homo sapiens
  Native (PRAME_HUMAN)
VLYPVPLESYEDIHGTLHLE

SEQ ID NO: 347853 - protein, 21 aa, Homo sapiens
  Native (PRAME_HUMAN)
VLYPVPLESYEDIHGTLHLER

SEQ ID NO: 347854 - protein, 22 aa, Homo sapiens
  Native (PRAME_HUMAN)
VLYPVPLESYEDIHGTLHLERL

SEQ ID NO: 347855 - protein, 23 aa, Homo sapiens
  Native (PRAME_HUMAN)
VLYPVPLESYEDIHGTLHLERLA

SEQ ID NO: 347856 - protein, 24 aa, Homo sapiens
  Native (PRAME_HUMAN)
VLYPVPLESYEDIHGTLHLERLAY

SEQ ID NO: 347857 - protein, 25 aa, Homo sapiens
  Native (PRAME_HUMAN)
VLYPVPLESYEDIHGTLHLERLAYL

SEQ ID NO: 347858 - protein, 14 aa, Homo sapiens
  Native (PRAME_HUMAN)
VMHLSQSPSVSQLS

SEQ ID NO: 347859 - protein, 15 aa, Homo sapiens
  Native (PRAME_HUMAN)
VMHLSQSPSVSQLSV

SEQ ID NO: 347860 - protein, 16 aa, Homo sapiens
  Native (PRAME_HUMAN)
VMHLSQSPSVSQLSVL

SEQ ID NO: 347861 - protein, 17 aa, Homo sapiens
  Native (PRAME_HUMAN)
VMHLSQSPSVSQLSVLS

SEQ ID NO: 347862 - protein, 18 aa, Homo sapiens
  Native (PRAME_HUMAN)
VMHLSQSPSVSQLSVLSL

SEQ ID NO: 347863 - protein, 19 aa, Homo sapiens
  Native (PRAME_HUMAN)
VMHLSQSPSVSQLSVLSLS

SEQ ID NO: 347864 - protein, 20 aa, Homo sapiens
  Native (PRAME_HUMAN)
VMHLSQSPSVSQLSVLSLSG

SEQ ID NO: 347865 - protein, 21 aa, Homo sapiens
  Native (PRAME_HUMAN)
VMHLSQSPSVSQLSVLSLSGV

SEQ ID NO: 347866 - protein, 22 aa, Homo sapiens
  Native (PRAME_HUMAN)
VMHLSQSPSVSQLSVLSLSGVM

SEQ ID NO: 347867 - protein, 23 aa, Homo sapiens
  Native (PRAME_HUMAN)
VMHLSQSPSVSQLSVLSLSGVML

SEQ ID NO: 347868 - protein, 24 aa, Homo sapiens
  Native (PRAME_HUMAN)
VMHLSQSPSVSQLSVLSLSGVMLT

SEQ ID NO: 347869 - protein, 25 aa, Homo sapiens
  Native (PRAME_HUMAN)
VMHLSQSPSVSQLSVLSLSGVMLTD

SEQ ID NO: 347870 - protein, 14 aa, Homo sapiens
  Native (PRAME_HUMAN)
VMLTDVSPEPLQAL

SEQ ID NO: 347871 - protein, 15 aa, Homo sapiens
  Native (PRAME_HUMAN)
VMLTDVSPEPLQALL

SEQ ID NO: 347872 - protein, 16 aa, Homo sapiens
  Native (PRAME_HUMAN)
VMLTDVSPEPLQALLE

SEQ ID NO: 347873 - protein, 17 aa, Homo sapiens
  Native (PRAME_HUMAN)
VMLTDVSPEPLQALLER

SEQ ID NO: 347874 - protein, 18 aa, Homo sapiens
  Native (PRAME_HUMAN)
VMLTDVSPEPLQALLERA

SEQ ID NO: 347875 - protein, 19 aa, Homo sapiens
  Native (PRAME_HUMAN)
VMLTDVSPEPLQALLERAS

SEQ ID NO: 347876 - protein, 20 aa, Homo sapiens
  Native (PRAME_HUMAN)
VMLTDVSPEPLQALLERASA

SEQ ID NO: 347877 - protein, 21 aa, Homo sapiens
  Native (PRAME_HUMAN)
VMLTDVSPEPLQALLERASAT

SEQ ID NO: 347878 - protein, 22 aa, Homo sapiens
  Native (PRAME_HUMAN)
VMLTDVSPEPLQALLERASATL

SEQ ID NO: 347879 - protein, 23 aa, Homo sapiens
  Native (PRAME_HUMAN)
VMLTDVSPEPLQALLERASATLQ

SEQ ID NO: 347880 - protein, 24 aa, Homo sapiens
  Native (PRAME_HUMAN)
VMLTDVSPEPLQALLERASATLQD

SEQ ID NO: 347881 - protein, 25 aa, Homo sapiens
  Native (PRAME_HUMAN)
VMLTDVSPEPLQALLERASATLQDL

SEQ ID NO: 347882 - protein, 15 aa, Homo sapiens
  Native (PRAME_HUMAN)
VMNPLETLSITNCRL

SEQ ID NO: 347883 - protein, 16 aa, Homo sapiens
  Native (PRAME_HUMAN)
VMNPLETLSITNCRLS

SEQ ID NO: 347884 - protein, 17 aa, Homo sapiens
  Native (PRAME_HUMAN)
VMNPLETLSITNCRLSE

SEQ ID NO: 347885 - protein, 19 aa, Homo sapiens
  Native (PRAME_HUMAN)
VMNPLETLSITNCRLSEGD

SEQ ID NO: 347886 - protein, 20 aa, Homo sapiens
  Native (PRAME_HUMAN)
VMNPLETLSITNCRLSEGDV

SEQ ID NO: 347887 - protein, 21 aa, Homo sapiens
  Native (PRAME_HUMAN)
VMNPLETLSITNCRLSEGDVM

SEQ ID NO: 347888 - protein, 22 aa, Homo sapiens
  Native (PRAME_HUMAN)
VMNPLETLSITNCRLSEGDVMH

SEQ ID NO: 347889 - protein, 23 aa, Homo sapiens
  Native (PRAME_HUMAN)
VMNPLETLSITNCRLSEGDVMHL

SEQ ID NO: 347890 - protein, 24 aa, Homo sapiens
  Native (PRAME_HUMAN)
VMNPLETLSITNCRLSEGDVMHLS

SEQ ID NO: 347891 - protein, 25 aa, Homo sapiens
  Native (PRAME_HUMAN)
VMNPLETLSITNCRLSEGDVMHLSQ

SEQ ID NO: 347892 - protein, 14 aa, Homo sapiens
  Native (PRAME_HUMAN)
VPLESYEDIHGTLH

SEQ ID NO: 347893 - protein, 15 aa, Homo sapiens
  Native (PRAME_HUMAN)
VPLESYEDIHGTLHL

SEQ ID NO: 347894 - protein, 16 aa, Homo sapiens
  Native (PRAME_HUMAN)
VPLESYEDIHGTLHLE

SEQ ID NO: 347895 - protein, 17 aa, Homo sapiens
  Native (PRAME_HUMAN)
VPLESYEDIHGTLHLER

SEQ ID NO: 347896 - protein, 18 aa, Homo sapiens
  Native (PRAME_HUMAN)
VPLESYEDIHGTLHLERL

SEQ ID NO: 347897 - protein, 19 aa, Homo sapiens
  Native (PRAME_HUMAN)
VPLESYEDIHGTLHLERLA

SEQ ID NO: 347898 - protein, 20 aa, Homo sapiens
  Native (PRAME_HUMAN)
VPLESYEDIHGTLHLERLAY

SEQ ID NO: 347899 - protein, 21 aa, Homo sapiens
  Native (PRAME_HUMAN)
VPLESYEDIHGTLHLERLAYL

SEQ ID NO: 347900 - protein, 22 aa, Homo sapiens
  Native (PRAME_HUMAN)
VPLESYEDIHGTLHLERLAYLH

SEQ ID NO: 347901 - protein, 23 aa, Homo sapiens
  Native (PRAME_HUMAN)
VPLESYEDIHGTLHLERLAYLHA

SEQ ID NO: 347902 - protein, 24 aa, Homo sapiens
  Native (PRAME_HUMAN)
VPLESYEDIHGTLHLERLAYLHAR

SEQ ID NO: 347903 - protein, 25 aa, Homo sapiens
  Native (PRAME_HUMAN)
VPLESYEDIHGTLHLERLAYLHARL

SEQ ID NO: 347904 - protein, 14 aa, Homo sapiens
  Native (PRAME_HUMAN)
VQAWPFTCLPLGVL

SEQ ID NO: 347905 - protein, 15 aa, Homo sapiens
  Native (PRAME_HUMAN)
VQAWPFTCLPLGVLM

SEQ ID NO: 347906 - protein, 16 aa, Homo sapiens
  Native (PRAME_HUMAN)
VQAWPFTCLPLGVLMK

SEQ ID NO: 347907 - protein, 17 aa, Homo sapiens
  Native (PRAME_HUMAN)
VQAWPFTCLPLGVLMKG

SEQ ID NO: 347908 - protein, 18 aa, Homo sapiens
  Native (PRAME_HUMAN)
VQAWPFTCLPLGVLMKGQ

SEQ ID NO: 347909 - protein, 19 aa, Homo sapiens
  Native (PRAME_HUMAN)
VQAWPFTCLPLGVLMKGQH

SEQ ID NO: 347910 - protein, 20 aa, Homo sapiens
  Native (PRAME_HUMAN)
VQAWPFTCLPLGVLMKGQHL

SEQ ID NO: 347911 - protein, 21 aa, Homo sapiens
  Native (PRAME_HUMAN)
VQAWPFTCLPLGVLMKGQHLH

SEQ ID NO: 347912 - protein, 22 aa, Homo sapiens
  Native (PRAME_HUMAN)
VQAWPFTCLPLGVLMKGQHLHL

SEQ ID NO: 347913 - protein, 23 aa, Homo sapiens
  Native (PRAME_HUMAN)
VQAWPFTCLPLGVLMKGQHLHLE

SEQ ID NO: 347914 - protein, 24 aa, Homo sapiens
  Native (PRAME_HUMAN)
VQAWPFTCLPLGVLMKGQHLHLET

SEQ ID NO: 347915 - protein, 25 aa, Homo sapiens
  Native (PRAME_HUMAN)
VQAWPFTCLPLGVLMKGQHLHLETF

SEQ ID NO: 347916 - protein, 13 aa, Homo sapiens
  Native (PRAME_HUMAN)
VQLDSIEDLEVTC

SEQ ID NO: 347917 - protein, 14 aa, Homo sapiens
  Native (PRAME_HUMAN)
VQLDSIEDLEVTCT

SEQ ID NO: 347918 - protein, 15 aa, Homo sapiens
  Native (PRAME_HUMAN)
VQLDSIEDLEVTCTW

SEQ ID NO: 347919 - protein, 16 aa, Homo sapiens
  Native (PRAME_HUMAN)
VQLDSIEDLEVTCTWK

SEQ ID NO: 347920 - protein, 17 aa, Homo sapiens
  Native (PRAME_HUMAN)
VQLDSIEDLEVTCTWKL

SEQ ID NO: 347921 - protein, 18 aa, Homo sapiens
  Native (PRAME_HUMAN)
VQLDSIEDLEVTCTWKLP

SEQ ID NO: 347922 - protein, 19 aa, Homo sapiens
  Native (PRAME_HUMAN)
VQLDSIEDLEVTCTWKLPT

SEQ ID NO: 347923 - protein, 20 aa, Homo sapiens
  Native (PRAME_HUMAN)
VQLDSIEDLEVTCTWKLPTL

SEQ ID NO: 347924 - protein, 21 aa, Homo sapiens
  Native (PRAME_HUMAN)
VQLDSIEDLEVTCTWKLPTLA

SEQ ID NO: 347925 - protein, 22 aa, Homo sapiens
  Native (PRAME_HUMAN)
VQLDSIEDLEVTCTWKLPTLAK

SEQ ID NO: 347926 - protein, 23 aa, Homo sapiens
  Native (PRAME_HUMAN)
VQLDSIEDLEVTCTWKLPTLAKF

SEQ ID NO: 347927 - protein, 24 aa, Homo sapiens
  Native (PRAME_HUMAN)
VQLDSIEDLEVTCTWKLPTLAKFS

SEQ ID NO: 347928 - protein, 25 aa, Homo sapiens
  Native (PRAME_HUMAN)
VQLDSIEDLEVTCTWKLPTLAKFSP

SEQ ID NO: 347929 - protein, 13 aa, Homo sapiens
  Native (PRAME_HUMAN)
VRPRRWKLQVLDL

SEQ ID NO: 347930 - protein, 14 aa, Homo sapiens
  Native (PRAME_HUMAN)
VRPRRWKLQVLDLR

SEQ ID NO: 347931 - protein, 15 aa, Homo sapiens
  Native (PRAME_HUMAN)
VRPRRWKLQVLDLRK

SEQ ID NO: 347932 - protein, 16 aa, Homo sapiens
  Native (PRAME_HUMAN)
VRPRRWKLQVLDLRKN

SEQ ID NO: 347933 - protein, 17 aa, Homo sapiens
  Native (PRAME_HUMAN)
VRPRRWKLQVLDLRKNS

SEQ ID NO: 347934 - protein, 18 aa, Homo sapiens
  Native (PRAME_HUMAN)
VRPRRWKLQVLDLRKNSH

SEQ ID NO: 347935 - protein, 19 aa, Homo sapiens
  Native (PRAME_HUMAN)
VRPRRWKLQVLDLRKNSHQ

SEQ ID NO: 347936 - protein, 20 aa, Homo sapiens
  Native (PRAME_HUMAN)
VRPRRWKLQVLDLRKNSHQD

SEQ ID NO: 347937 - protein, 21 aa, Homo sapiens
  Native (PRAME_HUMAN)
VRPRRWKLQVLDLRKNSHQDF

SEQ ID NO: 347938 - protein, 22 aa, Homo sapiens
  Native (PRAME_HUMAN)
VRPRRWKLQVLDLRKNSHQDFW

SEQ ID NO: 347939 - protein, 23 aa, Homo sapiens
  Native (PRAME_HUMAN)
VRPRRWKLQVLDLRKNSHQDFWT

SEQ ID NO: 347940 - protein, 24 aa, Homo sapiens
  Native (PRAME_HUMAN)
VRPRRWKLQVLDLRKNSHQDFWTV

SEQ ID NO: 347941 - protein, 25 aa, Homo sapiens
  Native (PRAME_HUMAN)
VRPRRWKLQVLDLRKNSHQDFWTVW

SEQ ID NO: 347942 - protein, 15 aa, Homo sapiens
  Native (PRAME_HUMAN)
VSPEPLQALLERASA

SEQ ID NO: 347943 - protein, 16 aa, Homo sapiens
  Native (PRAME_HUMAN)
VSPEPLQALLERASAT

SEQ ID NO: 347944 - protein, 17 aa, Homo sapiens
  Native (PRAME_HUMAN)
VSPEPLQALLERASATL

SEQ ID NO: 347945 - protein, 19 aa, Homo sapiens
  Native (PRAME_HUMAN)
VSPEPLQALLERASATLQD

SEQ ID NO: 347946 - protein, 20 aa, Homo sapiens
  Native (PRAME_HUMAN)
VSPEPLQALLERASATLQDL

SEQ ID NO: 347947 - protein, 21 aa, Homo sapiens
  Native (PRAME_HUMAN)
VSPEPLQALLERASATLQDLV

SEQ ID NO: 347948 - protein, 22 aa, Homo sapiens
  Native (PRAME_HUMAN)
VSPEPLQALLERASATLQDLVF

SEQ ID NO: 347949 - protein, 23 aa, Homo sapiens
  Native (PRAME_HUMAN)
VSPEPLQALLERASATLQDLVFD

SEQ ID NO: 347950 - protein, 24 aa, Homo sapiens
  Native (PRAME_HUMAN)
VSPEPLQALLERASATLQDLVFDE

SEQ ID NO: 347951 - protein, 25 aa, Homo sapiens
  Native (PRAME_HUMAN)
VSPEPLQALLERASATLQDLVFDEC

SEQ ID NO: 347952 - protein, 13 aa, Homo sapiens
  Native (PRAME_HUMAN)
VSQLSVLSLSGVM

SEQ ID NO: 347953 - protein, 14 aa, Homo sapiens
  Native (PRAME_HUMAN)
VSQLSVLSLSGVML

SEQ ID NO: 347954 - protein, 16 aa, Homo sapiens
  Native (PRAME_HUMAN)
VSQLSVLSLSGVMLTD

SEQ ID NO: 347955 - protein, 17 aa, Homo sapiens
  Native (PRAME_HUMAN)
VSQLSVLSLSGVMLTDV

SEQ ID NO: 347956 - protein, 18 aa, Homo sapiens
  Native (PRAME_HUMAN)
VSQLSVLSLSGVMLTDVS

SEQ ID NO: 347957 - protein, 19 aa, Homo sapiens
  Native (PRAME_HUMAN)
VSQLSVLSLSGVMLTDVSP

SEQ ID NO: 347958 - protein, 20 aa, Homo sapiens
  Native (PRAME_HUMAN)
VSQLSVLSLSGVMLTDVSPE

SEQ ID NO: 347959 - protein, 21 aa, Homo sapiens
  Native (PRAME_HUMAN)
VSQLSVLSLSGVMLTDVSPEP

SEQ ID NO: 347960 - protein, 22 aa, Homo sapiens
  Native (PRAME_HUMAN)
VSQLSVLSLSGVMLTDVSPEPL

SEQ ID NO: 347961 - protein, 23 aa, Homo sapiens
  Native (PRAME_HUMAN)
VSQLSVLSLSGVMLTDVSPEPLQ

SEQ ID NO: 347962 - protein, 24 aa, Homo sapiens
  Native (PRAME_HUMAN)
VSQLSVLSLSGVMLTDVSPEPLQA

SEQ ID NO: 347963 - protein, 25 aa, Homo sapiens
  Native (PRAME_HUMAN)
VSQLSVLSLSGVMLTDVSPEPLQAL

SEQ ID NO: 347964 - protein, 15 aa, Homo sapiens
  Native (PRAME_HUMAN)
VTCTWKLPTLAKFSP

SEQ ID NO: 347965 - protein, 16 aa, Homo sapiens
  Native (PRAME_HUMAN)
VTCTWKLPTLAKFSPY

SEQ ID NO: 347966 - protein, 17 aa, Homo sapiens
  Native (PRAME_HUMAN)
VTCTWKLPTLAKFSPYL

SEQ ID NO: 347967 - protein, 18 aa, Homo sapiens
  Native (PRAME_HUMAN)
VTCTWKLPTLAKFSPYLG

SEQ ID NO: 347968 - protein, 19 aa, Homo sapiens
  Native (PRAME_HUMAN)
VTCTWKLPTLAKFSPYLGQ

SEQ ID NO: 347969 - protein, 20 aa, Homo sapiens
  Native (PRAME_HUMAN)
VTCTWKLPTLAKFSPYLGQM

SEQ ID NO: 347970 - protein, 21 aa, Homo sapiens
  Native (PRAME_HUMAN)
VTCTWKLPTLAKFSPYLGQMI

SEQ ID NO: 347971 - protein, 22 aa, Homo sapiens
  Native (PRAME_HUMAN)
VTCTWKLPTLAKFSPYLGQMIN

SEQ ID NO: 347972 - protein, 23 aa, Homo sapiens
  Native (PRAME_HUMAN)
VTCTWKLPTLAKFSPYLGQMINL

SEQ ID NO: 347973 - protein, 24 aa, Homo sapiens
  Native (PRAME_HUMAN)
VTCTWKLPTLAKFSPYLGQMINLR

SEQ ID NO: 347974 - protein, 25 aa, Homo sapiens
  Native (PRAME_HUMAN)
VTCTWKLPTLAKFSPYLGQMINLRR

SEQ ID NO: 347975 - protein, 14 aa, Homo sapiens
  Native (PRAME_HUMAN)
VWSGNRASLYSFPE

SEQ ID NO: 347976 - protein, 15 aa, Homo sapiens
  Native (PRAME_HUMAN)
VWSGNRASLYSFPEP

SEQ ID NO: 347977 - protein, 16 aa, Homo sapiens
  Native (PRAME_HUMAN)
VWSGNRASLYSFPEPE

SEQ ID NO: 347978 - protein, 17 aa, Homo sapiens
  Native (PRAME_HUMAN)
VWSGNRASLYSFPEPEA

SEQ ID NO: 347979 - protein, 18 aa, Homo sapiens
  Native (PRAME_HUMAN)
VWSGNRASLYSFPEPEAA

SEQ ID NO: 347980 - protein, 19 aa, Homo sapiens
  Native (PRAME_HUMAN)
VWSGNRASLYSFPEPEAAQ

SEQ ID NO: 347981 - protein, 20 aa, Homo sapiens
  Native (PRAME_HUMAN)
VWSGNRASLYSFPEPEAAQP

SEQ ID NO: 347982 - protein, 21 aa, Homo sapiens
  Native (PRAME_HUMAN)
VWSGNRASLYSFPEPEAAQPM

SEQ ID NO: 347983 - protein, 22 aa, Homo sapiens
  Native (PRAME_HUMAN)
VWSGNRASLYSFPEPEAAQPMT

SEQ ID NO: 347984 - protein, 23 aa, Homo sapiens
  Native (PRAME_HUMAN)
VWSGNRASLYSFPEPEAAQPMTK

SEQ ID NO: 347985 - protein, 24 aa, Homo sapiens
  Native (PRAME_HUMAN)
VWSGNRASLYSFPEPEAAQPMTKK

SEQ ID NO: 347986 - protein, 25 aa, Homo sapiens
  Native (PRAME_HUMAN)
VWSGNRASLYSFPEPEAAQPMTKKR

SEQ ID NO: 347987 - protein, 15 aa, Homo sapiens
  Native (PRAME_HUMAN)
VWTSPRRLVELAGQS

SEQ ID NO: 347988 - protein, 16 aa, Homo sapiens
  Native (PRAME_HUMAN)
VWTSPRRLVELAGQSL

SEQ ID NO: 347989 - protein, 17 aa, Homo sapiens
  Native (PRAME_HUMAN)
VWTSPRRLVELAGQSLL

SEQ ID NO: 347990 - protein, 18 aa, Homo sapiens
  Native (PRAME_HUMAN)
VWTSPRRLVELAGQSLLK

SEQ ID NO: 347991 - protein, 19 aa, Homo sapiens
  Native (PRAME_HUMAN)
VWTSPRRLVELAGQSLLKD

SEQ ID NO: 347992 - protein, 20 aa, Homo sapiens
  Native (PRAME_HUMAN)
VWTSPRRLVELAGQSLLKDE

SEQ ID NO: 347993 - protein, 21 aa, Homo sapiens
  Native (PRAME_HUMAN)
VWTSPRRLVELAGQSLLKDEA

SEQ ID NO: 347994 - protein, 22 aa, Homo sapiens
  Native (PRAME_HUMAN)
VWTSPRRLVELAGQSLLKDEAL

SEQ ID NO: 347995 - protein, 23 aa, Homo sapiens
  Native (PRAME_HUMAN)
VWTSPRRLVELAGQSLLKDEALA

SEQ ID NO: 347996 - protein, 24 aa, Homo sapiens
  Native (PRAME_HUMAN)
VWTSPRRLVELAGQSLLKDEALAI

SEQ ID NO: 347997 - protein, 25 aa, Homo sapiens
  Native (PRAME_HUMAN)
VWTSPRRLVELAGQSLLKDEALAIA

SEQ ID NO: 347998 - protein, 14 aa, Homo sapiens
  Native (PRAME_HUMAN)
WGSIQSRYISMSVW

SEQ ID NO: 347999 - protein, 15 aa, Homo sapiens
  Native (PRAME_HUMAN)
WGSIQSRYISMSVWT

SEQ ID NO: 348000 - protein, 16 aa, Homo sapiens
  Native (PRAME_HUMAN)
WGSIQSRYISMSVWTS

SEQ ID NO: 348001 - protein, 17 aa, Homo sapiens
  Native (PRAME_HUMAN)
WGSIQSRYISMSVWTSP

SEQ ID NO: 348002 - protein, 18 aa, Homo sapiens
  Native (PRAME_HUMAN)
WGSIQSRYISMSVWTSPR

SEQ ID NO: 348003 - protein, 19 aa, Homo sapiens
  Native (PRAME_HUMAN)
WGSIQSRYISMSVWTSPRR

SEQ ID NO: 348004 - protein, 20 aa, Homo sapiens
  Native (PRAME_HUMAN)
WGSIQSRYISMSVWTSPRRL

SEQ ID NO: 348005 - protein, 21 aa, Homo sapiens
  Native (PRAME_HUMAN)
WGSIQSRYISMSVWTSPRRLV

SEQ ID NO: 348006 - protein, 22 aa, Homo sapiens
  Native (PRAME_HUMAN)
WGSIQSRYISMSVWTSPRRLVE

SEQ ID NO: 348007 - protein, 23 aa, Homo sapiens
  Native (PRAME_HUMAN)
WGSIQSRYISMSVWTSPRRLVEL

SEQ ID NO: 348008 - protein, 24 aa, Homo sapiens
  Native (PRAME_HUMAN)
WGSIQSRYISMSVWTSPRRLVELA

SEQ ID NO: 348009 - protein, 25 aa, Homo sapiens
  Native (PRAME_HUMAN)
WGSIQSRYISMSVWTSPRRLVELAG

SEQ ID NO: 348010 - protein, 14 aa, Homo sapiens
  Native (PRAME_HUMAN)
WKLPTLAKFSPYLG

SEQ ID NO: 348011 - protein, 15 aa, Homo sapiens
  Native (PRAME_HUMAN)
WKLPTLAKFSPYLGQ

SEQ ID NO: 348012 - protein, 16 aa, Homo sapiens
  Native (PRAME_HUMAN)
WKLPTLAKFSPYLGQM

SEQ ID NO: 348013 - protein, 17 aa, Homo sapiens
  Native (PRAME_HUMAN)
WKLPTLAKFSPYLGQMI

SEQ ID NO: 348014 - protein, 18 aa, Homo sapiens
  Native (PRAME_HUMAN)
WKLPTLAKFSPYLGQMIN

SEQ ID NO: 348015 - protein, 19 aa, Homo sapiens
  Native (PRAME_HUMAN)
WKLPTLAKFSPYLGQMINL

SEQ ID NO: 348016 - protein, 21 aa, Homo sapiens
  Native (PRAME_HUMAN)
WKLPTLAKFSPYLGQMINLRR

SEQ ID NO: 348017 - protein, 22 aa, Homo sapiens
  Native (PRAME_HUMAN)
WKLPTLAKFSPYLGQMINLRRL

SEQ ID NO: 348018 - protein, 23 aa, Homo sapiens
  Native (PRAME_HUMAN)
WKLPTLAKFSPYLGQMINLRRLL

SEQ ID NO: 348019 - protein, 24 aa, Homo sapiens
  Native (PRAME_HUMAN)
WKLPTLAKFSPYLGQMINLRRLLL

SEQ ID NO: 348020 - protein, 25 aa, Homo sapiens
  Native (PRAME_HUMAN)
WKLPTLAKFSPYLGQMINLRRLLLS

SEQ ID NO: 348021 - protein, 14 aa, Homo sapiens
  Native (PRAME_HUMAN)
WKLQVLDLRKNSHQ

SEQ ID NO: 348022 - protein, 15 aa, Homo sapiens
  Native (PRAME_HUMAN)
WKLQVLDLRKNSHQD

SEQ ID NO: 348023 - protein, 16 aa, Homo sapiens
  Native (PRAME_HUMAN)
WKLQVLDLRKNSHQDF

SEQ ID NO: 348024 - protein, 17 aa, Homo sapiens
  Native (PRAME_HUMAN)
WKLQVLDLRKNSHQDFW

SEQ ID NO: 348025 - protein, 19 aa, Homo sapiens
  Native (PRAME_HUMAN)
WKLQVLDLRKNSHQDFWTV

SEQ ID NO: 348026 - protein, 20 aa, Homo sapiens
  Native (PRAME_HUMAN)
WKLQVLDLRKNSHQDFWTVW

SEQ ID NO: 348027 - protein, 21 aa, Homo sapiens
  Native (PRAME_HUMAN)
WKLQVLDLRKNSHQDFWTVWS

SEQ ID NO: 348028 - protein, 22 aa, Homo sapiens
  Native (PRAME_HUMAN)
WKLQVLDLRKNSHQDFWTVWSG

SEQ ID NO: 348029 - protein, 23 aa, Homo sapiens
  Native (PRAME_HUMAN)
WKLQVLDLRKNSHQDFWTVWSGN

SEQ ID NO: 348030 - protein, 24 aa, Homo sapiens
  Native (PRAME_HUMAN)
WKLQVLDLRKNSHQDFWTVWSGNR

SEQ ID NO: 348031 - protein, 25 aa, Homo sapiens
  Native (PRAME_HUMAN)
WKLQVLDLRKNSHQDFWTVWSGNRA

SEQ ID NO: 348032 - protein, 13 aa, Homo sapiens
  Native (PRAME_HUMAN)
WPFTCLPLGVLMK

SEQ ID NO: 348033 - protein, 14 aa, Homo sapiens
  Native (PRAME_HUMAN)
WPFTCLPLGVLMKG

SEQ ID NO: 348034 - protein, 15 aa, Homo sapiens
  Native (PRAME_HUMAN)
WPFTCLPLGVLMKGQ

SEQ ID NO: 348035 - protein, 16 aa, Homo sapiens
  Native (PRAME_HUMAN)
WPFTCLPLGVLMKGQH

SEQ ID NO: 348036 - protein, 17 aa, Homo sapiens
  Native (PRAME_HUMAN)
WPFTCLPLGVLMKGQHL

SEQ ID NO: 348037 - protein, 18 aa, Homo sapiens
  Native (PRAME_HUMAN)
WPFTCLPLGVLMKGQHLH

SEQ ID NO: 348038 - protein, 19 aa, Homo sapiens
  Native (PRAME_HUMAN)
WPFTCLPLGVLMKGQHLHL

SEQ ID NO: 348039 - protein, 20 aa, Homo sapiens
  Native (PRAME_HUMAN)
WPFTCLPLGVLMKGQHLHLE

SEQ ID NO: 348040 - protein, 21 aa, Homo sapiens
  Native (PRAME_HUMAN)
WPFTCLPLGVLMKGQHLHLET

SEQ ID NO: 348041 - protein, 22 aa, Homo sapiens
  Native (PRAME_HUMAN)
WPFTCLPLGVLMKGQHLHLETF

SEQ ID NO: 348042 - protein, 23 aa, Homo sapiens
  Native (PRAME_HUMAN)
WPFTCLPLGVLMKGQHLHLETFK

SEQ ID NO: 348043 - protein, 24 aa, Homo sapiens
  Native (PRAME_HUMAN)
WPFTCLPLGVLMKGQHLHLETFKA

SEQ ID NO: 348044 - protein, 25 aa, Homo sapiens
  Native (PRAME_HUMAN)
WPFTCLPLGVLMKGQHLHLETFKAV

SEQ ID NO: 348045 - protein, 15 aa, Homo sapiens
  Native (PRAME_HUMAN)
WSGNRASLYSFPEPE

SEQ ID NO: 348046 - protein, 16 aa, Homo sapiens
  Native (PRAME_HUMAN)
WSGNRASLYSFPEPEA

SEQ ID NO: 348047 - protein, 17 aa, Homo sapiens
  Native (PRAME_HUMAN)
WSGNRASLYSFPEPEAA

SEQ ID NO: 348048 - protein, 18 aa, Homo sapiens
  Native (PRAME_HUMAN)
WSGNRASLYSFPEPEAAQ

SEQ ID NO: 348049 - protein, 19 aa, Homo sapiens
  Native (PRAME_HUMAN)
WSGNRASLYSFPEPEAAQP

SEQ ID NO: 348050 - protein, 20 aa, Homo sapiens
  Native (PRAME_HUMAN)
WSGNRASLYSFPEPEAAQPM

SEQ ID NO: 348051 - protein, 21 aa, Homo sapiens
  Native (PRAME_HUMAN)
WSGNRASLYSFPEPEAAQPMT

SEQ ID NO: 348052 - protein, 22 aa, Homo sapiens
  Native (PRAME_HUMAN)
WSGNRASLYSFPEPEAAQPMTK

SEQ ID NO: 348053 - protein, 23 aa, Homo sapiens
  Native (PRAME_HUMAN)
WSGNRASLYSFPEPEAAQPMTKK

SEQ ID NO: 348054 - protein, 24 aa, Homo sapiens
  Native (PRAME_HUMAN)
WSGNRASLYSFPEPEAAQPMTKKR

SEQ ID NO: 348055 - protein, 25 aa, Homo sapiens
  Native (PRAME_HUMAN)
WSGNRASLYSFPEPEAAQPMTKKRK

SEQ ID NO: 348056 - protein, 14 aa, Homo sapiens
  Native (PRAME_HUMAN)
WTSPRRLVELAGQS

SEQ ID NO: 348057 - protein, 15 aa, Homo sapiens
  Native (PRAME_HUMAN)
WTSPRRLVELAGQSL

SEQ ID NO: 348058 - protein, 16 aa, Homo sapiens
  Native (PRAME_HUMAN)
WTSPRRLVELAGQSLL

SEQ ID NO: 348059 - protein, 17 aa, Homo sapiens
  Native (PRAME_HUMAN)
WTSPRRLVELAGQSLLK

SEQ ID NO: 348060 - protein, 18 aa, Homo sapiens
  Native (PRAME_HUMAN)
WTSPRRLVELAGQSLLKD

SEQ ID NO: 348061 - protein, 19 aa, Homo sapiens
  Native (PRAME_HUMAN)
WTSPRRLVELAGQSLLKDE

SEQ ID NO: 348062 - protein, 21 aa, Homo sapiens
  Native (PRAME_HUMAN)
WTSPRRLVELAGQSLLKDEAL

SEQ ID NO: 348063 - protein, 22 aa, Homo sapiens
  Native (PRAME_HUMAN)
WTSPRRLVELAGQSLLKDEALA

SEQ ID NO: 348064 - protein, 23 aa, Homo sapiens
  Native (PRAME_HUMAN)
WTSPRRLVELAGQSLLKDEALAI

SEQ ID NO: 348065 - protein, 24 aa, Homo sapiens
  Native (PRAME_HUMAN)
WTSPRRLVELAGQSLLKDEALAIA

SEQ ID NO: 348066 - protein, 25 aa, Homo sapiens
  Native (PRAME_HUMAN)
WTSPRRLVELAGQSLLKDEALAIAA

SEQ ID NO: 348067 - protein, 13 aa, Homo sapiens
  Native (PRAME_HUMAN)
WTVWSGNRASLYS

SEQ ID NO: 348068 - protein, 14 aa, Homo sapiens
  Native (PRAME_HUMAN)
WTVWSGNRASLYSF

SEQ ID NO: 348069 - protein, 15 aa, Homo sapiens
  Native (PRAME_HUMAN)
WTVWSGNRASLYSFP

SEQ ID NO: 348070 - protein, 16 aa, Homo sapiens
  Native (PRAME_HUMAN)
WTVWSGNRASLYSFPE

SEQ ID NO: 348071 - protein, 17 aa, Homo sapiens
  Native (PRAME_HUMAN)
WTVWSGNRASLYSFPEP

SEQ ID NO: 348072 - protein, 18 aa, Homo sapiens
  Native (PRAME_HUMAN)
WTVWSGNRASLYSFPEPE

SEQ ID NO: 348073 - protein, 19 aa, Homo sapiens
  Native (PRAME_HUMAN)
WTVWSGNRASLYSFPEPEA

SEQ ID NO: 348074 - protein, 20 aa, Homo sapiens
  Native (PRAME_HUMAN)
WTVWSGNRASLYSFPEPEAA

SEQ ID NO: 348075 - protein, 21 aa, Homo sapiens
  Native (PRAME_HUMAN)
WTVWSGNRASLYSFPEPEAAQ

SEQ ID NO: 348076 - protein, 22 aa, Homo sapiens
  Native (PRAME_HUMAN)
WTVWSGNRASLYSFPEPEAAQP

SEQ ID NO: 348077 - protein, 23 aa, Homo sapiens
  Native (PRAME_HUMAN)
WTVWSGNRASLYSFPEPEAAQPM

SEQ ID NO: 348078 - protein, 24 aa, Homo sapiens
  Native (PRAME_HUMAN)
WTVWSGNRASLYSFPEPEAAQPMT

SEQ ID NO: 348079 - protein, 25 aa, Homo sapiens
  Native (PRAME_HUMAN)
WTVWSGNRASLYSFPEPEAAQPMTK

SEQ ID NO: 348080 - protein, 14 aa, Homo sapiens
  Native (PRAME_HUMAN)
YEDIHGTLHLERLA

SEQ ID NO: 348081 - protein, 15 aa, Homo sapiens
  Native (PRAME_HUMAN)
YEDIHGTLHLERLAY

SEQ ID NO: 348082 - protein, 16 aa, Homo sapiens
  Native (PRAME_HUMAN)
YEDIHGTLHLERLAYL

SEQ ID NO: 348083 - protein, 17 aa, Homo sapiens
  Native (PRAME_HUMAN)
YEDIHGTLHLERLAYLH

SEQ ID NO: 348084 - protein, 18 aa, Homo sapiens
  Native (PRAME_HUMAN)
YEDIHGTLHLERLAYLHA

SEQ ID NO: 348085 - protein, 19 aa, Homo sapiens
  Native (PRAME_HUMAN)
YEDIHGTLHLERLAYLHAR

SEQ ID NO: 348086 - protein, 20 aa, Homo sapiens
  Native (PRAME_HUMAN)
YEDIHGTLHLERLAYLHARL

SEQ ID NO: 348087 - protein, 21 aa, Homo sapiens
  Native (PRAME_HUMAN)
YEDIHGTLHLERLAYLHARLR

SEQ ID NO: 348088 - protein, 22 aa, Homo sapiens
  Native (PRAME_HUMAN)
YEDIHGTLHLERLAYLHARLRE

SEQ ID NO: 348089 - protein, 23 aa, Homo sapiens
  Native (PRAME_HUMAN)
YEDIHGTLHLERLAYLHARLREL

SEQ ID NO: 348090 - protein, 24 aa, Homo sapiens
  Native (PRAME_HUMAN)
YEDIHGTLHLERLAYLHARLRELL

SEQ ID NO: 348091 - protein, 25 aa, Homo sapiens
  Native (PRAME_HUMAN)
YEDIHGTLHLERLAYLHARLRELLC

SEQ ID NO: 348092 - protein, 13 aa, Homo sapiens
  Native (PRAME_HUMAN)
YGNSISISALQSL

SEQ ID NO: 348093 - protein, 14 aa, Homo sapiens
  Native (PRAME_HUMAN)
YGNSISISALQSLL

SEQ ID NO: 348094 - protein, 15 aa, Homo sapiens
  Native (PRAME_HUMAN)
YGNSISISALQSLLQ

SEQ ID NO: 348095 - protein, 16 aa, Homo sapiens
  Native (PRAME_HUMAN)
YGNSISISALQSLLQH

SEQ ID NO: 348096 - protein, 17 aa, Homo sapiens
  Native (PRAME_HUMAN)
YGNSISISALQSLLQHL

SEQ ID NO: 348097 - protein, 18 aa, Homo sapiens
  Native (PRAME_HUMAN)
YGNSISISALQSLLQHLI

SEQ ID NO: 348098 - protein, 19 aa, Homo sapiens
  Native (PRAME_HUMAN)
YGNSISISALQSLLQHLIG

SEQ ID NO: 348099 - protein, 20 aa, Homo sapiens
  Native (PRAME_HUMAN)
YGNSISISALQSLLQHLIGL

SEQ ID NO: 348100 - protein, 21 aa, Homo sapiens
  Native (PRAME_HUMAN)
YGNSISISALQSLLQHLIGLS

SEQ ID NO: 348101 - protein, 22 aa, Homo sapiens
  Native (PRAME_HUMAN)
YGNSISISALQSLLQHLIGLSN

SEQ ID NO: 348102 - protein, 23 aa, Homo sapiens
  Native (PRAME_HUMAN)
YGNSISISALQSLLQHLIGLSNL

SEQ ID NO: 348103 - protein, 24 aa, Homo sapiens
  Native (PRAME_HUMAN)
YGNSISISALQSLLQHLIGLSNLT

SEQ ID NO: 348104 - protein, 25 aa, Homo sapiens
  Native (PRAME_HUMAN)
YGNSISISALQSLLQHLIGLSNLTH

SEQ ID NO: 348105 - protein, 13 aa, Homo sapiens
  Native (PRAME_HUMAN)
YIAQFTSQFLSLQ

SEQ ID NO: 348106 - protein, 14 aa, Homo sapiens
  Native (PRAME_HUMAN)
YIAQFTSQFLSLQC

SEQ ID NO: 348107 - protein, 15 aa, Homo sapiens
  Native (PRAME_HUMAN)
YIAQFTSQFLSLQCL

SEQ ID NO: 348108 - protein, 16 aa, Homo sapiens
  Native (PRAME_HUMAN)
YIAQFTSQFLSLQCLQ

SEQ ID NO: 348109 - protein, 17 aa, Homo sapiens
  Native (PRAME_HUMAN)
YIAQFTSQFLSLQCLQA

SEQ ID NO: 348110 - protein, 18 aa, Homo sapiens
  Native (PRAME_HUMAN)
YIAQFTSQFLSLQCLQAL

SEQ ID NO: 348111 - protein, 19 aa, Homo sapiens
  Native (PRAME_HUMAN)
YIAQFTSQFLSLQCLQALY

SEQ ID NO: 348112 - protein, 20 aa, Homo sapiens
  Native (PRAME_HUMAN)
YIAQFTSQFLSLQCLQALYV

SEQ ID NO: 348113 - protein, 21 aa, Homo sapiens
  Native (PRAME_HUMAN)
YIAQFTSQFLSLQCLQALYVD

SEQ ID NO: 348114 - protein, 22 aa, Homo sapiens
  Native (PRAME_HUMAN)
YIAQFTSQFLSLQCLQALYVDS

SEQ ID NO: 348115 - protein, 23 aa, Homo sapiens
  Native (PRAME_HUMAN)
YIAQFTSQFLSLQCLQALYVDSL

SEQ ID NO: 348116 - protein, 24 aa, Homo sapiens
  Native (PRAME_HUMAN)
YIAQFTSQFLSLQCLQALYVDSLF

SEQ ID NO: 348117 - protein, 25 aa, Homo sapiens
  Native (PRAME_HUMAN)
YIAQFTSQFLSLQCLQALYVDSLFF

SEQ ID NO: 348118 - protein, 13 aa, Homo sapiens
  Native (PRAME_HUMAN)
YISMSVWTSPRRL

SEQ ID NO: 348119 - protein, 14 aa, Homo sapiens
  Native (PRAME_HUMAN)
YISMSVWTSPRRLV

SEQ ID NO: 348120 - protein, 15 aa, Homo sapiens
  Native (PRAME_HUMAN)
YISMSVWTSPRRLVE

SEQ ID NO: 348121 - protein, 16 aa, Homo sapiens
  Native (PRAME_HUMAN)
YISMSVWTSPRRLVEL

SEQ ID NO: 348122 - protein, 17 aa, Homo sapiens
  Native (PRAME_HUMAN)
YISMSVWTSPRRLVELA

SEQ ID NO: 348123 - protein, 18 aa, Homo sapiens
  Native (PRAME_HUMAN)
YISMSVWTSPRRLVELAG

SEQ ID NO: 348124 - protein, 19 aa, Homo sapiens
  Native (PRAME_HUMAN)
YISMSVWTSPRRLVELAGQ

SEQ ID NO: 348125 - protein, 20 aa, Homo sapiens
  Native (PRAME_HUMAN)
YISMSVWTSPRRLVELAGQS

SEQ ID NO: 348126 - protein, 21 aa, Homo sapiens
  Native (PRAME_HUMAN)
YISMSVWTSPRRLVELAGQSL

SEQ ID NO: 348127 - protein, 22 aa, Homo sapiens
  Native (PRAME_HUMAN)
YISMSVWTSPRRLVELAGQSLL

SEQ ID NO: 348128 - protein, 23 aa, Homo sapiens
  Native (PRAME_HUMAN)
YISMSVWTSPRRLVELAGQSLLK

SEQ ID NO: 348129 - protein, 24 aa, Homo sapiens
  Native (PRAME_HUMAN)
YISMSVWTSPRRLVELAGQSLLKD

SEQ ID NO: 348130 - protein, 25 aa, Homo sapiens
  Native (PRAME_HUMAN)
YISMSVWTSPRRLVELAGQSLLKDE

SEQ ID NO: 348131 - protein, 19 aa, Homo sapiens
  Native (PRAME_HUMAN)
YISPEKEEQYIAQFTSQFL

SEQ ID NO: 348132 - protein, 20 aa, Homo sapiens
  Native (PRAME_HUMAN)
YISPEKEEQYIAQFTSQFLS

SEQ ID NO: 348133 - protein, 21 aa, Homo sapiens
  Native (PRAME_HUMAN)
YISPEKEEQYIAQFTSQFLSL

SEQ ID NO: 348134 - protein, 22 aa, Homo sapiens
  Native (PRAME_HUMAN)
YISPEKEEQYIAQFTSQFLSLQ

SEQ ID NO: 348135 - protein, 23 aa, Homo sapiens
  Native (PRAME_HUMAN)
YISPEKEEQYIAQFTSQFLSLQC

SEQ ID NO: 348136 - protein, 24 aa, Homo sapiens
  Native (PRAME_HUMAN)
YISPEKEEQYIAQFTSQFLSLQCL

SEQ ID NO: 348137 - protein, 25 aa, Homo sapiens
  Native (PRAME_HUMAN)
YISPEKEEQYIAQFTSQFLSLQCLQ

SEQ ID NO: 348138 - protein, 13 aa, Homo sapiens
  Native (PRAME_HUMAN)
YLGQMINLRRLLL

SEQ ID NO: 348139 - protein, 14 aa, Homo sapiens
  Native (PRAME_HUMAN)
YLGQMINLRRLLLS

SEQ ID NO: 348140 - protein, 15 aa, Homo sapiens
  Native (PRAME_HUMAN)
YLGQMINLRRLLLSH

SEQ ID NO: 348141 - protein, 16 aa, Homo sapiens
  Native (PRAME_HUMAN)
YLGQMINLRRLLLSHI

SEQ ID NO: 348142 - protein, 17 aa, Homo sapiens
  Native (PRAME_HUMAN)
YLGQMINLRRLLLSHIH

SEQ ID NO: 348143 - protein, 18 aa, Homo sapiens
  Native (PRAME_HUMAN)
YLGQMINLRRLLLSHIHA

SEQ ID NO: 348144 - protein, 19 aa, Homo sapiens
  Native (PRAME_HUMAN)
YLGQMINLRRLLLSHIHAS

SEQ ID NO: 348145 - protein, 20 aa, Homo sapiens
  Native (PRAME_HUMAN)
YLGQMINLRRLLLSHIHASS

SEQ ID NO: 348146 - protein, 21 aa, Homo sapiens
  Native (PRAME_HUMAN)
YLGQMINLRRLLLSHIHASSY

SEQ ID NO: 348147 - protein, 22 aa, Homo sapiens
  Native (PRAME_HUMAN)
YLGQMINLRRLLLSHIHASSYI

SEQ ID NO: 348148 - protein, 23 aa, Homo sapiens
  Native (PRAME_HUMAN)
YLGQMINLRRLLLSHIHASSYIS

SEQ ID NO: 348149 - protein, 24 aa, Homo sapiens
  Native (PRAME_HUMAN)
YLGQMINLRRLLLSHIHASSYISP

SEQ ID NO: 348150 - protein, 25 aa, Homo sapiens
  Native (PRAME_HUMAN)
YLGQMINLRRLLLSHIHASSYISPE

SEQ ID NO: 348151 - protein, 13 aa, Homo sapiens
  Native (PRAME_HUMAN)
YLHARLRELLCEL

SEQ ID NO: 348152 - protein, 14 aa, Homo sapiens
  Native (PRAME_HUMAN)
YLHARLRELLCELG

SEQ ID NO: 348153 - protein, 15 aa, Homo sapiens
  Native (PRAME_HUMAN)
YLHARLRELLCELGR

SEQ ID NO: 348154 - protein, 16 aa, Homo sapiens
  Native (PRAME_HUMAN)
YLHARLRELLCELGRP

SEQ ID NO: 348155 - protein, 17 aa, Homo sapiens
  Native (PRAME_HUMAN)
YLHARLRELLCELGRPS

SEQ ID NO: 348156 - protein, 18 aa, Homo sapiens
  Native (PRAME_HUMAN)
YLHARLRELLCELGRPSM

SEQ ID NO: 348157 - protein, 19 aa, Homo sapiens
  Native (PRAME_HUMAN)
YLHARLRELLCELGRPSMV

SEQ ID NO: 348158 - protein, 20 aa, Homo sapiens
  Native (PRAME_HUMAN)
YLHARLRELLCELGRPSMVW

SEQ ID NO: 348159 - protein, 21 aa, Homo sapiens
  Native (PRAME_HUMAN)
YLHARLRELLCELGRPSMVWL

SEQ ID NO: 348160 - protein, 22 aa, Homo sapiens
  Native (PRAME_HUMAN)
YLHARLRELLCELGRPSMVWLS

SEQ ID NO: 348161 - protein, 23 aa, Homo sapiens
  Native (PRAME_HUMAN)
YLHARLRELLCELGRPSMVWLSA

SEQ ID NO: 348162 - protein, 24 aa, Homo sapiens
  Native (PRAME_HUMAN)
YLHARLRELLCELGRPSMVWLSAN

SEQ ID NO: 348163 - protein, 25 aa, Homo sapiens
  Native (PRAME_HUMAN)
YLHARLRELLCELGRPSMVWLSANP

SEQ ID NO: 348164 - protein, 13 aa, Homo sapiens
  Native (PRAME_HUMAN)
YLIEKVKRKKNVL

SEQ ID NO: 348165 - protein, 14 aa, Homo sapiens
  Native (PRAME_HUMAN)
YLIEKVKRKKNVLR

SEQ ID NO: 348166 - protein, 15 aa, Homo sapiens
  Native (PRAME_HUMAN)
YLIEKVKRKKNVLRL

SEQ ID NO: 348167 - protein, 16 aa, Homo sapiens
  Native (PRAME_HUMAN)
YLIEKVKRKKNVLRLC

SEQ ID NO: 348168 - protein, 17 aa, Homo sapiens
  Native (PRAME_HUMAN)
YLIEKVKRKKNVLRLCC

SEQ ID NO: 348169 - protein, 18 aa, Homo sapiens
  Native (PRAME_HUMAN)
YLIEKVKRKKNVLRLCCK

SEQ ID NO: 348170 - protein, 19 aa, Homo sapiens
  Native (PRAME_HUMAN)
YLIEKVKRKKNVLRLCCKK

SEQ ID NO: 348171 - protein, 20 aa, Homo sapiens
  Native (PRAME_HUMAN)
YLIEKVKRKKNVLRLCCKKL

SEQ ID NO: 348172 - protein, 21 aa, Homo sapiens
  Native (PRAME_HUMAN)
YLIEKVKRKKNVLRLCCKKLK

SEQ ID NO: 348173 - protein, 22 aa, Homo sapiens
  Native (PRAME_HUMAN)
YLIEKVKRKKNVLRLCCKKLKI

SEQ ID NO: 348174 - protein, 23 aa, Homo sapiens
  Native (PRAME_HUMAN)
YLIEKVKRKKNVLRLCCKKLKIF

SEQ ID NO: 348175 - protein, 24 aa, Homo sapiens
  Native (PRAME_HUMAN)
YLIEKVKRKKNVLRLCCKKLKIFA

SEQ ID NO: 348176 - protein, 25 aa, Homo sapiens
  Native (PRAME_HUMAN)
YLIEKVKRKKNVLRLCCKKLKIFAM

SEQ ID NO: 348177 - protein, 14 aa, Homo sapiens
  Native (PRAME_HUMAN)
YPVPLESYEDIHGT

SEQ ID NO: 348178 - protein, 15 aa, Homo sapiens
  Native (PRAME_HUMAN)
YPVPLESYEDIHGTL

SEQ ID NO: 348179 - protein, 16 aa, Homo sapiens
  Native (PRAME_HUMAN)
YPVPLESYEDIHGTLH

SEQ ID NO: 348180 - protein, 17 aa, Homo sapiens
  Native (PRAME_HUMAN)
YPVPLESYEDIHGTLHL

SEQ ID NO: 348181 - protein, 18 aa, Homo sapiens
  Native (PRAME_HUMAN)
YPVPLESYEDIHGTLHLE

SEQ ID NO: 348182 - protein, 19 aa, Homo sapiens
  Native (PRAME_HUMAN)
YPVPLESYEDIHGTLHLER

SEQ ID NO: 348183 - protein, 20 aa, Homo sapiens
  Native (PRAME_HUMAN)
YPVPLESYEDIHGTLHLERL

SEQ ID NO: 348184 - protein, 21 aa, Homo sapiens
  Native (PRAME_HUMAN)
YPVPLESYEDIHGTLHLERLA

SEQ ID NO: 348185 - protein, 22 aa, Homo sapiens
  Native (PRAME_HUMAN)
YPVPLESYEDIHGTLHLERLAY

SEQ ID NO: 348186 - protein, 23 aa, Homo sapiens
  Native (PRAME_HUMAN)
YPVPLESYEDIHGTLHLERLAYL

SEQ ID NO: 348187 - protein, 24 aa, Homo sapiens
  Native (PRAME_HUMAN)
YPVPLESYEDIHGTLHLERLAYLH

SEQ ID NO: 348188 - protein, 25 aa, Homo sapiens
  Native (PRAME_HUMAN)
YPVPLESYEDIHGTLHLERLAYLHA

SEQ ID NO: 348189 - protein, 15 aa, Homo sapiens
  Native (PRAME_HUMAN)
YSFPEPEAAQPMTKK

SEQ ID NO: 348190 - protein, 16 aa, Homo sapiens
  Native (PRAME_HUMAN)
YSFPEPEAAQPMTKKR

SEQ ID NO: 348191 - protein, 17 aa, Homo sapiens
  Native (PRAME_HUMAN)
YSFPEPEAAQPMTKKRK

SEQ ID NO: 348192 - protein, 19 aa, Homo sapiens
  Native (PRAME_HUMAN)
YSFPEPEAAQPMTKKRKVD

SEQ ID NO: 348193 - protein, 20 aa, Homo sapiens
  Native (PRAME_HUMAN)
YSFPEPEAAQPMTKKRKVDG

SEQ ID NO: 348194 - protein, 25 aa, Homo sapiens
  Native (PRAME_HUMAN)
YSFPEPEAAQPMTKKRKVDGLSTEA

SEQ ID NO: 348195 - protein, 13 aa, Homo sapiens
  Native (PRAME_HUMAN)
YVDSLFFLRGRLD

SEQ ID NO: 348196 - protein, 14 aa, Homo sapiens
  Native (PRAME_HUMAN)
YVDSLFFLRGRLDQ

SEQ ID NO: 348197 - protein, 15 aa, Homo sapiens
  Native (PRAME_HUMAN)
YVDSLFFLRGRLDQL

SEQ ID NO: 348198 - protein, 16 aa, Homo sapiens
  Native (PRAME_HUMAN)
YVDSLFFLRGRLDQLL

SEQ ID NO: 348199 - protein, 17 aa, Homo sapiens
  Native (PRAME_HUMAN)
YVDSLFFLRGRLDQLLR

SEQ ID NO: 348200 - protein, 18 aa, Homo sapiens
  Native (PRAME_HUMAN)
YVDSLFFLRGRLDQLLRH

SEQ ID NO: 348201 - protein, 19 aa, Homo sapiens
  Native (PRAME_HUMAN)
YVDSLFFLRGRLDQLLRHV

SEQ ID NO: 348202 - protein, 20 aa, Homo sapiens
  Native (PRAME_HUMAN)
YVDSLFFLRGRLDQLLRHVM

SEQ ID NO: 348203 - protein, 21 aa, Homo sapiens
  Native (PRAME_HUMAN)
YVDSLFFLRGRLDQLLRHVMN

SEQ ID NO: 348204 - protein, 22 aa, Homo sapiens
  Native (PRAME_HUMAN)
YVDSLFFLRGRLDQLLRHVMNP

SEQ ID NO: 348205 - protein, 23 aa, Homo sapiens
  Native (PRAME_HUMAN)
YVDSLFFLRGRLDQLLRHVMNPL

SEQ ID NO: 348206 - protein, 24 aa, Homo sapiens
  Native (PRAME_HUMAN)
YVDSLFFLRGRLDQLLRHVMNPLE

SEQ ID NO: 348207 - protein, 25 aa, Homo sapiens
  Native (PRAME_HUMAN)
YVDSLFFLRGRLDQLLRHVMNPLET

SEQ ID NO: 348208 - protein, 15 aa, Artificial Sequence
  Description of Artificial Sequence: Synthetic peptide
  Seed: KKLKIFAMPMQDIKM (PRAME_HUMAN)
  Core: LKIFAMPMQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KKXKIXAXPMXDIKM

SEQ ID NO: 348209 - protein, 15 aa, Artificial Sequence
  Description of Artificial Sequence: Synthetic peptide
  Seed: KKLKIFAMPMQDIKM (PRAME_HUMAN)
  Core: KIFAMPMQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KKLXIFXMXMQXIKM

SEQ ID NO: 348210 - protein, 15 aa, Artificial Sequence
  Description of Artificial Sequence: Synthetic peptide
  Seed: KKLKIFAMPMQDIKM (PRAME_HUMAN)
  Core: IFAMPMQDI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KKLKXFAXPXQDXKM

SEQ ID NO: 348211 - protein, 15 aa, Artificial Sequence
  Description of Artificial Sequence: Synthetic peptide
  Seed: KKLKIFAMPMQDIKM (PRAME_HUMAN)
  Core: AMPMQDIKM
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Glu, Phe, Gly, Ile, Leu, Met, Asn, Gln, Ser, Thr, Val, Trp, or Tyr
  misc_feature (12)..(12): Xaa can be Ala, Cys, Asp, Glu, Gly, Ile, Leu, Met, Asn, Pro, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KKLKIFXMPXQXIKX

SEQ ID NO: 348212 - protein, 15 aa, Artificial Sequence
  Description of Artificial Sequence: Synthetic peptide
  Seed: LERLAYLHARLRELL (PRAME_HUMAN)
  Core: ERLAYLHAR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRLXYXHAXLRELL

SEQ ID NO: 348213 - protein, 15 aa, Artificial Sequence
  Description of Artificial Sequence: Synthetic peptide
  Seed: LERLAYLHARLRELL (PRAME_HUMAN)
  Core: LAYLHARLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LERXAYXHXRLXELL

SEQ ID NO: 348214 - protein, 15 aa, Artificial Sequence
  Description of Artificial Sequence: Synthetic peptide
  Seed: LERLAYLHARLRELL (PRAME_HUMAN)
  Core: YLHARLREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LERLAXLHXRXREXL

SEQ ID NO: 348215 - protein, 15 aa, Artificial Sequence
  Description of Artificial Sequence: Synthetic peptide
  Seed: AAFDGRHSQTLKAMV (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMV

SEQ ID NO: 348216 - protein, 15 aa, Artificial Sequence
  Description of Artificial Sequence: Synthetic peptide
  Seed: AAFDGRHSQTLKAMV (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMV

SEQ ID NO: 348217 - protein, 16 aa, Artificial Sequence
  Description of Artificial Sequence: Synthetic peptide
  Seed: AAFDGRHSQTLKAMVQ (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQ

SEQ ID NO: 348218 - protein, 17 aa, Artificial Sequence
  Description of Artificial Sequence: Synthetic peptide
  Seed: AAFDGRHSQTLKAMVQA (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQA

SEQ ID NO: 348219 - protein, 17 aa, Artificial Sequence
  Description of Artificial Sequence: Synthetic peptide
  Seed: AAFDGRHSQTLKAMVQA (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQA

SEQ ID NO: 348220 - protein, 18 aa, Artificial Sequence
  Description of Artificial Sequence: Synthetic peptide
  Seed: AAFDGRHSQTLKAMVQAW (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAW

SEQ ID NO: 348221 - protein, 19 aa, Artificial Sequence
  Description of Artificial Sequence: Synthetic peptide
  Seed: AAFDGRHSQTLKAMVQAWP (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWP

SEQ ID NO: 348222 - protein, 19 aa, Artificial Sequence
  Description of Artificial Sequence: Synthetic peptide
  Seed: AAFDGRHSQTLKAMVQAWP (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWP

SEQ ID NO: 348223 - protein, 20 aa, Artificial Sequence
  Description of Artificial Sequence: Synthetic peptide
  Seed: AAFDGRHSQTLKAMVQAWPF (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPF

SEQ ID NO: 348224 - protein, 20 aa, Artificial Sequence
  Description of Artificial Sequence: Synthetic peptide
  Seed: AAFDGRHSQTLKAMVQAWPF (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPF

SEQ ID NO: 348225 - protein, 20 aa, Artificial Sequence
  Description of Artificial Sequence: Synthetic peptide
  Seed: AAFDGRHSQTLKAMVQAWPF (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPF

SEQ ID NO: 348226 - protein, 20 aa, Artificial Sequence
  Description of Artificial Sequence: Synthetic peptide
  Seed: AAFDGRHSQTLKAMVQAWPF (PRAME_HUMAN)
  Core: HSQTLKAMV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRXSQXLXAMXQAWPF

SEQ ID NO: 348227 - protein, 20 aa, Artificial Sequence
  Description of Artificial Sequence: Synthetic peptide
  Seed: AAFDGRHSQTLKAMVQAWPF (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPF

SEQ ID NO: 348228 - protein, 20 aa, Artificial Sequence
  Description of Artificial Sequence: Synthetic peptide
  Seed: AAFDGRHSQTLKAMVQAWPF (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXF

SEQ ID NO: 348229 - protein, 21 aa, Artificial Sequence
  Description of Artificial Sequence: Synthetic peptide
  Seed: AAFDGRHSQTLKAMVQAWPFT (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPFT

SEQ ID NO: 348230 - protein, 21 aa, Artificial Sequence
  Description of Artificial Sequence: Synthetic peptide
  Seed: AAFDGRHSQTLKAMVQAWPFT (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPFT

SEQ ID NO: 348231 - protein, 21 aa, Artificial Sequence
  Description of Artificial Sequence: Synthetic peptide
  Seed: AAFDGRHSQTLKAMVQAWPFT (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPFT

SEQ ID NO: 348232 - protein, 21 aa, Artificial Sequence
  Description of Artificial Sequence: Synthetic peptide
  Seed: AAFDGRHSQTLKAMVQAWPFT (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPFT

SEQ ID NO: 348233 - protein, 21 aa, Artificial Sequence
  Description of Artificial Sequence: Synthetic peptide
  Seed: AAFDGRHSQTLKAMVQAWPFT (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXFT

SEQ ID NO: 348234 - protein, 21 aa, Artificial Sequence
  Description of Artificial Sequence: Synthetic peptide
  Seed: AAFDGRHSQTLKAMVQAWPFT (PRAME_HUMAN)
  Core: KAMVQAWPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLXAMXQXWPXT

SEQ ID NO: 348235 - protein, 22 aa, Artificial Sequence
  Description of Artificial Sequence: Synthetic peptide
  Seed: AAFDGRHSQTLKAMVQAWPFTC (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPFTC

SEQ ID NO: 348236 - protein, 22 aa, Artificial Sequence
  Description of Artificial Sequence: Synthetic peptide
  Seed: AAFDGRHSQTLKAMVQAWPFTC (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPFTC

SEQ ID NO: 348237 - protein, 22 aa, Artificial Sequence
  Description of Artificial Sequence: Synthetic peptide
  Seed: AAFDGRHSQTLKAMVQAWPFTC (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPFTC

SEQ ID NO: 348238 - protein, 22 aa, Artificial Sequence
  Description of Artificial Sequence: Synthetic peptide
  Seed: AAFDGRHSQTLKAMVQAWPFTC (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPFTC

SEQ ID NO: 348239 - protein, 22 aa, Artificial Sequence
  Description of Artificial Sequence: Synthetic peptide
  Seed: AAFDGRHSQTLKAMVQAWPFTC (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXFTC

SEQ ID NO: 348240 - protein, 22 aa, Artificial Sequence
  Description of Artificial Sequence: Synthetic peptide
  Seed: AAFDGRHSQTLKAMVQAWPFTC (PRAME_HUMAN)
  Core: KAMVQAWPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLXAMXQXWPXTC

SEQ ID NO: 348241 - protein, 23 aa, Artificial Sequence
  Description of Artificial Sequence: Synthetic peptide
  Seed: AAFDGRHSQTLKAMVQAWPFTCL (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPFTCL

SEQ ID NO: 348242 - protein, 23 aa, Artificial Sequence
  Description of Artificial Sequence: Synthetic peptide
  Seed: AAFDGRHSQTLKAMVQAWPFTCL (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPFTCL

SEQ ID NO: 348243 - protein, 23 aa, Artificial Sequence
  Description of Artificial Sequence: Synthetic peptide
  Seed: AAFDGRHSQTLKAMVQAWPFTCL (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPFTCL

SEQ ID NO: 348244 - protein, 23 aa, Artificial Sequence
  Description of Artificial Sequence: Synthetic peptide
  Seed: AAFDGRHSQTLKAMVQAWPFTCL (PRAME_HUMAN)
  Core: HSQTLKAMV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRXSQXLXAMXQAWPFTCL

SEQ ID NO: 348245 - protein, 23 aa, Artificial Sequence
  Description of Artificial Sequence: Synthetic peptide
  Seed: AAFDGRHSQTLKAMVQAWPFTCL (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPFTCL

SEQ ID NO: 348246 - protein, 23 aa, Artificial Sequence
  Description of Artificial Sequence: Synthetic peptide
  Seed: AAFDGRHSQTLKAMVQAWPFTCL (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXFTCL

SEQ ID NO: 348247 - protein, 23 aa, Artificial Sequence
  Description of Artificial Sequence: Synthetic peptide
  Seed: AAFDGRHSQTLKAMVQAWPFTCL (PRAME_HUMAN)
  Core: KAMVQAWPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLXAMXQXWPXTCL

SEQ ID NO: 348248 - protein, 24 aa, Artificial Sequence
  Description of Artificial Sequence: Synthetic peptide
  Seed: AAFDGRHSQTLKAMVQAWPFTCLP (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPFTCLP

SEQ ID NO: 348249 - protein, 24 aa, Artificial Sequence
  Description of Artificial Sequence: Synthetic peptide
  Seed: AAFDGRHSQTLKAMVQAWPFTCLP (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPFTCLP

SEQ ID NO: 348250 - protein, 24 aa, Artificial Sequence
  Description of Artificial Sequence: Synthetic peptide
  Seed: AAFDGRHSQTLKAMVQAWPFTCLP (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPFTCLP

SEQ ID NO: 348251 - protein, 24 aa, Artificial Sequence
  Description of Artificial Sequence: Synthetic peptide
  Seed: AAFDGRHSQTLKAMVQAWPFTCLP (PRAME_HUMAN)
  Core: HSQTLKAMV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRXSQXLXAMXQAWPFTCLP

SEQ ID NO: 348252 - protein, 24 aa, Artificial Sequence
  Description of Artificial Sequence: Synthetic peptide
  Seed: AAFDGRHSQTLKAMVQAWPFTCLP (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPFTCLP

SEQ ID NO: 348253 - protein, 24 aa, Artificial Sequence
  Description of Artificial Sequence: Synthetic peptide
  Seed: AAFDGRHSQTLKAMVQAWPFTCLP (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXFTCLP

SEQ ID NO: 348254 - protein, 24 aa, Artificial Sequence
  Description of Artificial Sequence: Synthetic peptide
  Seed: AAFDGRHSQTLKAMVQAWPFTCLP (PRAME_HUMAN)
  Core: KAMVQAWPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLXAMXQXWPXTCLP

SEQ ID NO: 348255 - protein, 24 aa, Artificial Sequence
  Description of Artificial Sequence: Synthetic peptide
  Seed: AAFDGRHSQTLKAMVQAWPFTCLP (PRAME_HUMAN)
  Core: MVQAWPFTC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLKAXVQXWXFTXLP

SEQ ID NO: 348256 - protein, 24 aa, Artificial Sequence
  Description of Artificial Sequence: Synthetic peptide
  Seed: AAFDGRHSQTLKAMVQAWPFTCLP (PRAME_HUMAN)
  Core: VQAWPFTCL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLKAMXQAXPXTCXP

SEQ ID NO: 348257 - protein, 25 aa, Artificial Sequence
  Description of Artificial Sequence: Synthetic peptide
  Seed: AAFDGRHSQTLKAMVQAWPFTCLPL (PRAME_HUMAN)
  Core: FDGRHSQTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXDGXHXQTXKAMVQAWPFTCLPL

SEQ ID NO: 348258 - protein, 25 aa, Artificial Sequence
  Description of Artificial Sequence: Synthetic peptide
  Seed: AAFDGRHSQTLKAMVQAWPFTCLPL (PRAME_HUMAN)
  Core: GRHSQTLKA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAFDXRHXQXLKXMVQAWPFTCLPL

SEQ ID NO: 348259 - protein, 25 aa, Artificial Sequence
  Description of Artificial Sequence: Synthetic peptide
  Seed: AAFDGRHSQTLKAMVQAWPFTCLPL (PRAME_HUMAN)
  Core: RHSQTLKAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGXHSXTXKAXVQAWPFTCLPL

SEQ ID NO: 348260 - protein, 25 aa, Artificial Sequence
  Description of Artificial Sequence: Synthetic peptide
  Seed: AAFDGRHSQTLKAMVQAWPFTCLPL (PRAME_HUMAN)
  Core: HSQTLKAMV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRXSQXLXAMXQAWPFTCLPL

SEQ ID NO: 348261 - protein, 25 aa, Artificial Sequence
  Description of Artificial Sequence: Synthetic peptide
  Seed: AAFDGRHSQTLKAMVQAWPFTCLPL (PRAME_HUMAN)
  Core: SQTLKAMVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHXQTXKXMVXAWPFTCLPL

SEQ ID NO: 348262 - protein, 25 aa, Artificial Sequence
  Description of Artificial Sequence: Synthetic peptide
  Seed: AAFDGRHSQTLKAMVQAWPFTCLPL (PRAME_HUMAN)
  Core: LKAMVQAWP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTXKAXVXAWXFTCLPL

SEQ ID NO: 348263 - protein, 25 aa, Artificial Sequence
  Description of Artificial Sequence: Synthetic peptide
  Seed: AAFDGRHSQTLKAMVQAWPFTCLPL (PRAME_HUMAN)
  Core: KAMVQAWPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLXAMXQXWPXTCLPL

SEQ ID NO: 348264 - protein, 25 aa, Artificial Sequence
  Description of Artificial Sequence: Synthetic peptide
  Seed: AAFDGRHSQTLKAMVQAWPFTCLPL (PRAME_HUMAN)
  Core: MVQAWPFTC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLKAXVQXWXFTXLPL

SEQ ID NO: 348265 - protein, 25 aa, Artificial Sequence
  Description of Artificial Sequence: Synthetic peptide
  Seed: AAFDGRHSQTLKAMVQAWPFTCLPL (PRAME_HUMAN)
  Core: VQAWPFTCL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AAFDGRHSQTLKAMXQAXPXTCXPL

SEQ ID NO: 348266 - protein, 14 aa, Artificial Sequence
  Description of Artificial Sequence: Synthetic peptide
  Seed: AALELLPRELFPPL (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPL

SEQ ID NO: 348267 - protein, 15 aa, Artificial Sequence
  Description of Artificial Sequence: Synthetic peptide
  Seed: AALELLPRELFPPLF (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLF

SEQ ID NO: 348268 - protein, 15 aa, Artificial Sequence
  Description of Artificial Sequence: Synthetic peptide
  Seed: AALELLPRELFPPLF (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLF

SEQ ID NO: 348269 - protein, 16 aa, Artificial Sequence
  Description of Artificial Sequence: Synthetic peptide
  Seed: AALELLPRELFPPLFM (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFM

SEQ ID NO: 348270 - protein, 16 aa, Artificial Sequence
  Description of Artificial Sequence: Synthetic peptide
  Seed: AALELLPRELFPPLFM (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFM

SEQ ID NO: 348271 - protein, 16 aa, Artificial Sequence
  Description of Artificial Sequence: Synthetic peptide
  Seed: AALELLPRELFPPLFM (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXM

SEQ ID NO: 348272 - protein, 16 aa, Artificial Sequence
  Description of Artificial Sequence: Synthetic peptide
  Seed: AALELLPRELFPPLFM (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFX

SEQ ID NO: 348273 - protein, 17 aa, Artificial Sequence
  Description of Artificial Sequence: Synthetic peptide
  Seed: AALELLPRELFPPLFMA (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMA

SEQ ID NO: 348274 - protein, 17 aa, Artificial Sequence
  Description of Artificial Sequence: Synthetic peptide
  Seed: AALELLPRELFPPLFMA (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFMA

SEQ ID NO: 348275 - protein, 17 aa, Artificial Sequence
  Description of Artificial Sequence: Synthetic peptide
  Seed: AALELLPRELFPPLFMA (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMA

SEQ ID NO: 348276 - protein, 17 aa, Artificial Sequence
  Description of Artificial Sequence: Synthetic peptide
  Seed: AALELLPRELFPPLFMA (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXA

SEQ ID NO: 348277 - protein, 18 aa, Artificial Sequence
  Description of Artificial Sequence: Synthetic peptide
  Seed: AALELLPRELFPPLFMAA (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAA

SEQ ID NO: 348278 - protein, 18 aa, Artificial Sequence
  Description of Artificial Sequence: Synthetic peptide
  Seed: AALELLPRELFPPLFMAA (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFMAA

SEQ ID NO: 348279 - protein, 18 aa, Artificial Sequence
  Description of Artificial Sequence: Synthetic peptide
  Seed: AALELLPRELFPPLFMAA (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAA

SEQ ID NO: 348280 - protein, 18 aa, Artificial Sequence
  Description of Artificial Sequence: Synthetic peptide
  Seed: AALELLPRELFPPLFMAA (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAX

SEQ ID NO: 348281 - protein, 19 aa, Artificial Sequence
  Description of Artificial Sequence: Synthetic peptide
  Seed: AALELLPRELFPPLFMAAF (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAF

SEQ ID NO: 348282 - protein, 19 aa, Artificial Sequence
  Description of Artificial Sequence: Synthetic peptide
  Seed: AALELLPRELFPPLFMAAF (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFMAAF

SEQ ID NO: 348283 - protein, 19 aa, Artificial Sequence
  Description of Artificial Sequence: Synthetic peptide
  Seed: AALELLPRELFPPLFMAAF (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAF

SEQ ID NO: 348284 - protein, 19 aa, Artificial Sequence
  Description of Artificial Sequence: Synthetic peptide
  Seed: AALELLPRELFPPLFMAAF (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAF

SEQ ID NO: 348285 - protein, 19 aa, Artificial Sequence
  Description of Artificial Sequence: Synthetic peptide
  Seed: AALELLPRELFPPLFMAAF (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXF

SEQ ID NO: 348286 - protein, 20 aa, Artificial Sequence
  Description of Artificial Sequence: Synthetic peptide
  Seed: AALELLPRELFPPLFMAAFD (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFD

SEQ ID NO: 348287 - protein, 20 aa, Artificial Sequence
  Description of Artificial Sequence: Synthetic peptide
  Seed: AALELLPRELFPPLFMAAFD (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFMAAFD

SEQ ID NO: 348288 - protein, 20 aa, Artificial Sequence
  Description of Artificial Sequence: Synthetic peptide
  Seed: AALELLPRELFPPLFMAAFD (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFD

SEQ ID NO: 348289 - protein, 20 aa, Artificial Sequence
  Description of Artificial Sequence: Synthetic peptide
  Seed: AALELLPRELFPPLFMAAFD (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFD

SEQ ID NO: 348290 - protein, 20 aa, Artificial Sequence
  Description of Artificial Sequence: Synthetic peptide
  Seed: AALELLPRELFPPLFMAAFD (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFD

SEQ ID NO: 348291 - protein, 21 aa, Artificial Sequence
  Description of Artificial Sequence: Synthetic peptide
  Seed: AALELLPRELFPPLFMAAFDG (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFDG

SEQ ID NO: 348292 - protein, 21 aa, Artificial Sequence
  Description of Artificial Sequence: Synthetic peptide
  Seed: AALELLPRELFPPLFMAAFDG (PRAME_HUMAN)
  Core: LLPRELFPP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AALEXLPXEXFPXLFMAAFDG

SEQ ID NO: 348293 - protein, 21 aa, Artificial Sequence
  Description of Artificial Sequence: Synthetic peptide
  Seed: AALELLPRELFPPLFMAAFDG (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFDG

SEQ ID NO: 348294 - protein, 21 aa, Artificial Sequence
  Description of Artificial Sequence: Synthetic peptide
  Seed: AALELLPRELFPPLFMAAFDG (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFDG

SEQ ID NO: 348295 - protein, 21 aa, Artificial Sequence
  Description of Artificial Sequence: Synthetic peptide
  Seed: AALELLPRELFPPLFMAAFDG (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFDG

SEQ ID NO: 348296 - protein, 22 aa, Artificial Sequence
  Description of Artificial Sequence: Synthetic peptide
  Seed: AALELLPRELFPPLFMAAFDGR (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFDGR

SEQ ID NO: 348297 - protein, 22 aa, Artificial Sequence
  Description of Artificial Sequence: Synthetic peptide
  Seed: AALELLPRELFPPLFMAAFDGR (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFDGR

SEQ ID NO: 348298 - protein, 22 aa, Artificial Sequence
  Description of Artificial Sequence: Synthetic peptide
  Seed: AALELLPRELFPPLFMAAFDGR (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFDGR

SEQ ID NO: 348299 - protein, 22 aa, Artificial Sequence
  Description of Artificial Sequence: Synthetic peptide
  Seed: AALELLPRELFPPLFMAAFDGR (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFDGR

SEQ ID NO: 348300 - protein, 22 aa, Artificial Sequence
  Description of Artificial Sequence: Synthetic peptide
  Seed: AALELLPRELFPPLFMAAFDGR (PRAME_HUMAN)
  Core: PLFMAAFDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPXLFXAXFDXR

SEQ ID NO: 348301 - protein, 23 aa, Artificial Sequence
  Description of Artificial Sequence: Synthetic peptide
  Seed: AALELLPRELFPPLFMAAFDGRH (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFDGRH

SEQ ID NO: 348302 - protein, 23 aa, Artificial Sequence
  Description of Artificial Sequence: Synthetic peptide
  Seed: AALELLPRELFPPLFMAAFDGRH (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFDGRH

SEQ ID NO: 348303 - protein, 23 aa, Artificial Sequence
  Description of Artificial Sequence: Synthetic peptide
  Seed: AALELLPRELFPPLFMAAFDGRH (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFDGRH

SEQ ID NO: 348304 - protein, 23 aa, Artificial Sequence
  Description of Artificial Sequence: Synthetic peptide
  Seed: AALELLPRELFPPLFMAAFDGRH (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFDGRH

SEQ ID NO: 348305 - protein, 23 aa, Artificial Sequence
  Description of Artificial Sequence: Synthetic peptide
  Seed: AALELLPRELFPPLFMAAFDGRH (PRAME_HUMAN)
  Core: PLFMAAFDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPXLFXAXFDXRH

SEQ ID NO: 348306 - protein, 24 aa, Artificial Sequence
  Description of Artificial Sequence: Synthetic peptide
  Seed: AALELLPRELFPPLFMAAFDGRHS (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFDGRHS

SEQ ID NO: 348307 - protein, 24 aa, Artificial Sequence
  Description of Artificial Sequence: Synthetic peptide
  Seed: AALELLPRELFPPLFMAAFDGRHS (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFDGRHS

SEQ ID NO: 348308 - protein, 24 aa, Artificial Sequence
  Description of Artificial Sequence: Synthetic peptide
  Seed: AALELLPRELFPPLFMAAFDGRHS (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFDGRHS

SEQ ID NO: 348309 - protein, 24 aa, Artificial Sequence
  Description of Artificial Sequence: Synthetic peptide
  Seed: AALELLPRELFPPLFMAAFDGRHS (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFDGRHS

SEQ ID NO: 348310 - protein, 24 aa, Artificial Sequence
  Description of Artificial Sequence: Synthetic peptide
  Seed: AALELLPRELFPPLFMAAFDGRHS (PRAME_HUMAN)
  Core: PLFMAAFDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPXLFXAXFDXRHS

SEQ ID NO: 348311 - protein, 24 aa, Artificial Sequence
  Description of Artificial Sequence: Synthetic peptide
  Seed: AALELLPRELFPPLFMAAFDGRHS (PRAME_HUMAN)
  Core: LFMAAFDGR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPXFMXAXDGXHS

SEQ ID NO: 348312 - protein, 24 aa, Artificial Sequence
  Description of Artificial Sequence: Synthetic peptide
  Seed: AALELLPRELFPPLFMAAFDGRHS (PRAME_HUMAN)
  Core: FMAAFDGRH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPLXMAXFXGRXS

SEQ ID NO: 348313 - protein, 24 aa, Artificial Sequence
  Description of Artificial Sequence: Synthetic peptide
  Seed: AALELLPRELFPPLFMAAFDGRHS (PRAME_HUMAN)
  Core: MAAFDGRHS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPLFXAAXDXRHX

SEQ ID NO: 348314 - protein, 25 aa, Artificial Sequence
  Description of Artificial Sequence: Synthetic peptide
  Seed: AALELLPRELFPPLFMAAFDGRHSQ (PRAME_HUMAN)
  Core: LELLPRELF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXELXPXELXPPLFMAAFDGRHSQ

SEQ ID NO: 348315 - protein, 25 aa, Artificial Sequence
  Description of Artificial Sequence: Synthetic peptide
  Seed: AALELLPRELFPPLFMAAFDGRHSQ (PRAME_HUMAN)
  Core: PRELFPPLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AALELLXREXFXPLXMAAFDGRHSQ

SEQ ID NO: 348316 - protein, 25 aa, Artificial Sequence
  Description of Artificial Sequence: Synthetic peptide
  Seed: AALELLPRELFPPLFMAAFDGRHSQ (PRAME_HUMAN)
  Core: RELFPPLFM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPXELXPXLFXAAFDGRHSQ

SEQ ID NO: 348317 - protein, 25 aa, Artificial Sequence
  Description of Artificial Sequence: Synthetic peptide
  Seed: AALELLPRELFPPLFMAAFDGRHSQ (PRAME_HUMAN)
  Core: LFPPLFMAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPREXFPXLXMAXFDGRHSQ

SEQ ID NO: 348318 - protein, 25 aa, Artificial Sequence
  Description of Artificial Sequence: Synthetic peptide
  Seed: AALELLPRELFPPLFMAAFDGRHSQ (PRAME_HUMAN)
  Core: PLFMAAFDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPXLFXAXFDXRHSQ

SEQ ID NO: 348319 - protein, 25 aa, Artificial Sequence
  Description of Artificial Sequence: Synthetic peptide
  Seed: AALELLPRELFPPLFMAAFDGRHSQ (PRAME_HUMAN)
  Core: LFMAAFDGR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPXFMXAXDGXHSQ

SEQ ID NO: 348320 - protein, 25 aa, Artificial Sequence
  Description of Artificial Sequence: Synthetic peptide
  Seed: AALELLPRELFPPLFMAAFDGRHSQ (PRAME_HUMAN)
  Core: FMAAFDGRH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPLXMAXFXGRXSQ

SEQ ID NO: 348321 - protein, 25 aa, Artificial Sequence
  Description of Artificial Sequence: Synthetic peptide
  Seed: AALELLPRELFPPLFMAAFDGRHSQ (PRAME_HUMAN)
  Core: MAAFDGRHS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AALELLPRELFPPLFXAAXDXRHXQ

SEQ ID NO: 348322 - protein, 15 aa, Artificial Sequence
  Description of Artificial Sequence: Synthetic peptide
  Seed: AAQPMTKKRKVDGLS (PRAME_HUMAN)
  Core: MTKKRKVDG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAQPXTKXRXVDXLS

SEQ ID NO: 348323 - protein, 17 aa, Artificial Sequence
  Description of Artificial Sequence: Synthetic peptide
  Seed: AAQPMTKKRKVDGLSTE (PRAME_HUMAN)
  Core: MTKKRKVDG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAQPXTKXRXVDXLSTE

SEQ ID NO: 348324 - protein, 22 aa, Artificial Sequence
  Description of Artificial Sequence: Synthetic peptide
  Seed: AAQPMTKKRKVDGLSTEAEQPF (PRAME_HUMAN)
  Core: LSTEAEQPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKRKVDGXSTXAXQPX

SEQ ID NO: 348325 - protein, 23 aa, Artificial Sequence
  Description of Artificial Sequence: Synthetic peptide
  Seed: AAQPMTKKRKVDGLSTEAEQPFI (PRAME_HUMAN)
  Core: LSTEAEQPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKRKVDGXSTXAXQPXI

SEQ ID NO: 348326 - protein, 24 aa, Artificial Sequence
  Description of Artificial Sequence: Synthetic peptide
  Seed: AAQPMTKKRKVDGLSTEAEQPFIP (PRAME_HUMAN)
  Core: RKVDGLSTE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKXKVXGXSTXAEQPFIP

SEQ ID NO: 348327 - protein, 24 aa, Artificial Sequence
  Description of Artificial Sequence: Synthetic peptide
  Seed: AAQPMTKKRKVDGLSTEAEQPFIP (PRAME_HUMAN)
  Core: LSTEAEQPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKRKVDGXSTXAXQPXIP

SEQ ID NO: 348328 - protein, 25 aa, Artificial Sequence
  Description of Artificial Sequence: Synthetic peptide
  Seed: AAQPMTKKRKVDGLSTEAEQPFIPV (PRAME_HUMAN)
  Core: RKVDGLSTE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKXKVXGXSTXAEQPFIPV

SEQ ID NO: 348329 - protein, 25 aa, Artificial Sequence
  Description of Artificial Sequence: Synthetic peptide
  Seed: AAQPMTKKRKVDGLSTEAEQPFIPV (PRAME_HUMAN)
  Core: LSTEAEQPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AAQPMTKKRKVDGXSTXAXQPXIPV

SEQ ID NO: 348330 - protein, 13 aa, Artificial Sequence
  Description of Artificial Sequence: Synthetic peptide
  Seed: ACDELFSYLIEKV (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKX

SEQ ID NO: 348331 - protein, 14 aa, Artificial Sequence
  Description of Artificial Sequence: Synthetic peptide
  Seed: ACDELFSYLIEKVK (PRAME_HUMAN)
  Core: ELFSYLIEK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ACDXLFXYXIEXVK

SEQ ID NO: 348332 - protein, 14 aa, Artificial Sequence
  Description of Artificial Sequence: Synthetic peptide
  Seed: ACDELFSYLIEKVK (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXK

SEQ ID NO: 348333 - protein, 14 aa, Artificial Sequence
  Description of Artificial Sequence: Synthetic peptide
  Seed: ACDELFSYLIEKVK (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVX

SEQ ID NO: 348334 - protein, 15 aa, Artificial Sequence
  Description of Artificial Sequence: Synthetic peptide
  Seed: ACDELFSYLIEKVKR (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKR

SEQ ID NO: 348335 - protein, 15 aa, Artificial Sequence
  Description of Artificial Sequence: Synthetic peptide
  Seed: ACDELFSYLIEKVKR (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXR

SEQ ID NO: 348336 - protein, 16 aa, Artificial Sequence
  Description of Artificial Sequence: Synthetic peptide
  Seed: ACDELFSYLIEKVKRK (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRK

SEQ ID NO: 348337 - protein, 16 aa, Artificial Sequence
  Description of Artificial Sequence: Synthetic peptide
  Seed: ACDELFSYLIEKVKRK (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRK

SEQ ID NO: 348338 - protein, 17 aa, Artificial Sequence
  Description of Artificial Sequence: Synthetic peptide
  Seed: ACDELFSYLIEKVKRKK (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKK

SEQ ID NO: 348339 - protein, 17 aa, Artificial Sequence
  Description of Artificial Sequence: Synthetic peptide
  Seed: ACDELFSYLIEKVKRKK (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKK

SEQ ID NO: 348340 - protein, 18 aa, Artificial Sequence
  Description of Artificial Sequence: Synthetic peptide
  Seed: ACDELFSYLIEKVKRKKN (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKN

SEQ ID NO: 348341 - protein, 18 aa, Artificial Sequence
  Description of Artificial Sequence: Synthetic peptide
  Seed: ACDELFSYLIEKVKRKKN (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKN

SEQ ID NO: 348342 - protein, 18 aa, Artificial Sequence
  Description of Artificial Sequence: Synthetic peptide
  Seed: ACDELFSYLIEKVKRKKN (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKN

SEQ ID NO: 348343 - protein, 18 aa, Artificial Sequence
  Description of Artificial Sequence: Synthetic peptide
  Seed: ACDELFSYLIEKVKRKKN (PRAME_HUMAN)
  Core: LIEKVKRKK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYXIEXVXRKXN

SEQ ID NO: 348344 - protein, 18 aa, Artificial Sequence
  Description of Artificial Sequence: Synthetic peptide
  Seed: ACDELFSYLIEKVKRKKN (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKX

SEQ ID NO: 348345 - protein, 19 aa, Artificial Sequence
  Description of Artificial Sequence: Synthetic peptide
  Seed: ACDELFSYLIEKVKRKKNV (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNV

SEQ ID NO: 348346 - protein, 19 aa, Artificial Sequence
  Description of Artificial Sequence: Synthetic peptide
  Seed: ACDELFSYLIEKVKRKKNV (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNV

SEQ ID NO: 348347 - protein, 19 aa, Artificial Sequence
  Description of Artificial Sequence: Synthetic peptide
  Seed: ACDELFSYLIEKVKRKKNV (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNV

SEQ ID NO: 348348 - protein, 19 aa, Artificial Sequence
  Description of Artificial Sequence: Synthetic peptide
  Seed: ACDELFSYLIEKVKRKKNV (PRAME_HUMAN)
  Core: LIEKVKRKK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYXIEXVXRKXNV

SEQ ID NO: 348349 - protein, 19 aa, Artificial Sequence
  Description of Artificial Sequence: Synthetic peptide
  Seed: ACDELFSYLIEKVKRKKNV (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXV

SEQ ID NO: 348350 - protein, 20 aa, Artificial Sequence
  Description of Artificial Sequence: Synthetic peptide
  Seed: ACDELFSYLIEKVKRKKNVL (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVL

SEQ ID NO: 348351 - protein, 20 aa, Artificial Sequence
  Description of Artificial Sequence: Synthetic peptide
  Seed: ACDELFSYLIEKVKRKKNVL (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVL

SEQ ID NO: 348352 - protein, 20 aa, Artificial Sequence
  Description of Artificial Sequence: Synthetic peptide
  Seed: ACDELFSYLIEKVKRKKNVL (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVL

SEQ ID NO: 348353 - protein, 20 aa, Artificial Sequence
  Description of Artificial Sequence: Synthetic peptide
  Seed: ACDELFSYLIEKVKRKKNVL (PRAME_HUMAN)
  Core: LIEKVKRKK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYXIEXVXRKXNVL

SEQ ID NO: 348354 - protein, 20 aa, Artificial Sequence
  Description of Artificial Sequence: Synthetic peptide
  Seed: ACDELFSYLIEKVKRKKNVL (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVL

SEQ ID NO: 348355 - protein, 21 aa, Artificial Sequence
  Description of Artificial Sequence: Synthetic peptide
  Seed: ACDELFSYLIEKVKRKKNVLR (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVLR

SEQ ID NO: 348356 - protein, 21 aa, Artificial Sequence
  Description of Artificial Sequence: Synthetic peptide
  Seed: ACDELFSYLIEKVKRKKNVLR (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVLR

SEQ ID NO: 348357 - protein, 21 aa, Artificial Sequence
  Description of Artificial Sequence: Synthetic peptide
  Seed: ACDELFSYLIEKVKRKKNVLR (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVLR

SEQ ID NO: 348358 - protein, 21 aa, Artificial Sequence
  Description of Artificial Sequence: Synthetic peptide
  Seed: ACDELFSYLIEKVKRKKNVLR (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVLR

SEQ ID NO: 348359 - protein, 22 aa, Artificial Sequence
  Description of Artificial Sequence: Synthetic peptide
  Seed: ACDELFSYLIEKVKRKKNVLRL (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVLRL

SEQ ID NO: 348360 - protein, 22 aa, Artificial Sequence
  Description of Artificial Sequence: Synthetic peptide
  Seed: ACDELFSYLIEKVKRKKNVLRL (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVLRL

SEQ ID NO: 348361 - protein, 22 aa, Artificial Sequence
  Description of Artificial Sequence: Synthetic peptide
  Seed: ACDELFSYLIEKVKRKKNVLRL (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVLRL

SEQ ID NO: 348362 - protein, 22 aa, Artificial Sequence
  Description of Artificial Sequence: Synthetic peptide
  Seed: ACDELFSYLIEKVKRKKNVLRL (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVLRL

SEQ ID NO: 348363 - protein, 22 aa, Artificial Sequence
  Description of Artificial Sequence: Synthetic peptide
  Seed: ACDELFSYLIEKVKRKKNVLRL (PRAME_HUMAN)
  Core: VKRKKNVLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLIEKXKRXKXVLXL

SEQ ID NO: 348364 - protein, 22 aa, Artificial Sequence
  Description of Artificial Sequence: Synthetic peptide
  Seed: ACDELFSYLIEKVKRKKNVLRL (PRAME_HUMAN)
  Core: KRKKNVLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLIEKVXRKXNXLRX

SEQ ID NO: 348365 - protein, 23 aa, Artificial Sequence
  Description of Artificial Sequence: Synthetic peptide
  Seed: ACDELFSYLIEKVKRKKNVLRLC (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVLRLC

SEQ ID NO: 348366 - protein, 23 aa, Artificial Sequence
  Description of Artificial Sequence: Synthetic peptide
  Seed: ACDELFSYLIEKVKRKKNVLRLC (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVLRLC

SEQ ID NO: 348367 - protein, 23 aa, Artificial Sequence
  Description of Artificial Sequence: Synthetic peptide
  Seed: ACDELFSYLIEKVKRKKNVLRLC (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVLRLC

SEQ ID NO: 348368 - protein, 23 aa, Artificial Sequence
  Description of Artificial Sequence: Synthetic peptide
  Seed: ACDELFSYLIEKVKRKKNVLRLC (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVLRLC

SEQ ID NO: 348369 - protein, 23 aa, Artificial Sequence
  Description of Artificial Sequence: Synthetic peptide
  Seed: ACDELFSYLIEKVKRKKNVLRLC (PRAME_HUMAN)
  Core: KRKKNVLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLIEKVXRKXNXLRXC

SEQ ID NO: 348370 - protein, 24 aa, Artificial Sequence
  Description of Artificial Sequence: Synthetic peptide
  Seed: ACDELFSYLIEKVKRKKNVLRLCC (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVLRLCC

SEQ ID NO: 348371 - protein, 24 aa, Artificial Sequence
  Description of Artificial Sequence: Synthetic peptide
  Seed: ACDELFSYLIEKVKRKKNVLRLCC (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVLRLCC

SEQ ID NO: 348372 - protein, 24 aa, Artificial Sequence
  Description of Artificial Sequence: Synthetic peptide
  Seed: ACDELFSYLIEKVKRKKNVLRLCC (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVLRLCC

SEQ ID NO: 348373 - protein, 24 aa, Artificial Sequence
  Description of Artificial Sequence: Synthetic peptide
  Seed: ACDELFSYLIEKVKRKKNVLRLCC (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVLRLCC

SEQ ID NO: 348374 - protein, 24 aa, Artificial Sequence
  Description of Artificial Sequence: Synthetic peptide
  Seed: ACDELFSYLIEKVKRKKNVLRLCC (PRAME_HUMAN)
  Core: KRKKNVLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLIEKVXRKXNXLRXCC

SEQ ID NO: 348375 - protein, 25 aa, Artificial Sequence
  Description of Artificial Sequence: Synthetic peptide
  Seed: ACDELFSYLIEKVKRKKNVLRLCCK (PRAME_HUMAN)
  Core: LFSYLIEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ACDEXFSXLXEKXKRKKNVLRLCCK

SEQ ID NO: 348376 - protein, 25 aa, Artificial Sequence
  Description of Artificial Sequence: Synthetic peptide
  Seed: ACDELFSYLIEKVKRKKNVLRLCCK (PRAME_HUMAN)
  Core: FSYLIEKVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ACDELXSYXIXKVXRKKNVLRLCCK

SEQ ID NO: 348377 - protein, 25 aa, Artificial Sequence
  Description of Artificial Sequence: Synthetic peptide
  Seed: ACDELFSYLIEKVKRKKNVLRLCCK (PRAME_HUMAN)
  Core: YLIEKVKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSXLIXKXKRXKNVLRLCCK

SEQ ID NO: 348378 - protein, 25 aa, Artificial Sequence
  Description of Artificial Sequence: Synthetic peptide
  Seed: ACDELFSYLIEKVKRKKNVLRLCCK (PRAME_HUMAN)
  Core: IEKVKRKKN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLXEKXKXKKXVLRLCCK

SEQ ID NO: 348379 - protein, 25 aa, Artificial Sequence
  Description of Artificial Sequence: Synthetic peptide
  Seed: ACDELFSYLIEKVKRKKNVLRLCCK (PRAME_HUMAN)
  Core: KRKKNVLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ACDELFSYLIEKVXRKXNXLRXCCK

SEQ ID NO: 348380 - protein, 13 aa, Artificial Sequence
  Description of Artificial Sequence: Synthetic peptide
  Seed: AEQPFIPVEVLVD (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVX

SEQ ID NO: 348381 - protein, 14 aa, Artificial Sequence
  Description of Artificial Sequence: Synthetic peptide
  Seed: AEQPFIPVEVLVDL (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXL

SEQ ID NO: 348382 - protein, 15 aa, Artificial Sequence
  Description of Artificial Sequence: Synthetic peptide
  Seed: AEQPFIPVEVLVDLF (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLF

SEQ ID NO: 348383 - protein, 16 aa, Artificial Sequence
  Description of Artificial Sequence: Synthetic peptide
  Seed: AEQPFIPVEVLVDLFL (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFL

SEQ ID NO: 348384 - protein, 17 aa, Artificial Sequence
  Description of Artificial Sequence: Synthetic peptide
  Seed: AEQPFIPVEVLVDLFLK (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLK

SEQ ID NO: 348385 - protein, 18 aa, Artificial Sequence
  Description of Artificial Sequence: Synthetic peptide
  Seed: AEQPFIPVEVLVDLFLKE (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKE

SEQ ID NO: 348386 - protein, 19 aa, Artificial Sequence
  Description of Artificial Sequence: Synthetic peptide
  Seed: AEQPFIPVEVLVDLFLKEG (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEG

SEQ ID NO: 348387 - protein, 19 aa, Artificial Sequence
  Description of Artificial Sequence: Synthetic peptide
  Seed: AEQPFIPVEVLVDLFLKEG (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXG

SEQ ID NO: 348388 - protein, 20 aa, Artificial Sequence
  Description of Artificial Sequence: Synthetic peptide
  Seed: AEQPFIPVEVLVDLFLKEGA (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGA

SEQ ID NO: 348389 - protein, 20 aa, Artificial Sequence
  Description of Artificial Sequence: Synthetic peptide
  Seed: AEQPFIPVEVLVDLFLKEGA (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGA

SEQ ID NO: 348390 - protein, 21 aa, Artificial Sequence
  Description of Artificial Sequence: Synthetic peptide
  Seed: AEQPFIPVEVLVDLFLKEGAC (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGAC

SEQ ID NO: 348391 - protein, 21 aa, Artificial Sequence
  Description of Artificial Sequence: Synthetic peptide
  Seed: AEQPFIPVEVLVDLFLKEGAC (PRAME_HUMAN)
  Core: VEVLVDLFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPXEVXVXLFXKEGAC

SEQ ID NO: 348392 - protein, 21 aa, Artificial Sequence
  Description of Artificial Sequence: Synthetic peptide
  Seed: AEQPFIPVEVLVDLFLKEGAC (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGAC

SEQ ID NO: 348393 - protein, 22 aa, Artificial Sequence
  Description of Artificial Sequence: Synthetic peptide
  Seed: AEQPFIPVEVLVDLFLKEGACD (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGACD

SEQ ID NO: 348394 - protein, 22 aa, Artificial Sequence
  Description of Artificial Sequence: Synthetic peptide
  Seed: AEQPFIPVEVLVDLFLKEGACD (PRAME_HUMAN)
  Core: VEVLVDLFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPXEVXVXLFXKEGACD

SEQ ID NO: 348395 - protein, 22 aa, Artificial Sequence
  Description of Artificial Sequence: Synthetic peptide
  Seed: AEQPFIPVEVLVDLFLKEGACD (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGACD

SEQ ID NO: 348396 - protein, 23 aa, Artificial Sequence
  Description of Artificial Sequence: Synthetic peptide
  Seed: AEQPFIPVEVLVDLFLKEGACDE (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGACDE

SEQ ID NO: 348397 - protein, 23 aa, Artificial Sequence
  Description of Artificial Sequence: Synthetic peptide
  Seed: AEQPFIPVEVLVDLFLKEGACDE (PRAME_HUMAN)
  Core: VEVLVDLFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPXEVXVXLFXKEGACDE

SEQ ID NO: 348398 - protein, 23 aa, Artificial Sequence
  Description of Artificial Sequence: Synthetic peptide
  Seed: AEQPFIPVEVLVDLFLKEGACDE (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGACDE

SEQ ID NO: 348399 - protein, 24 aa, Artificial Sequence
  Description of Artificial Sequence: Synthetic peptide
  Seed: AEQPFIPVEVLVDLFLKEGACDEL (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGACDEL

SEQ ID NO: 348400 - protein, 24 aa, Artificial Sequence
  Description of Artificial Sequence: Synthetic peptide
  Seed: AEQPFIPVEVLVDLFLKEGACDEL (PRAME_HUMAN)
  Core: VEVLVDLFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPXEVXVXLFXKEGACDEL

SEQ ID NO: 348401 - protein, 24 aa, Artificial Sequence
  Description of Artificial Sequence: Synthetic peptide
  Seed: AEQPFIPVEVLVDLFLKEGACDEL (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGACDEL

SEQ ID NO: 348402 - protein, 25 aa, Artificial Sequence
  Description of Artificial Sequence: Synthetic peptide
  Seed: AEQPFIPVEVLVDLFLKEGACDELF (PRAME_HUMAN)
  Core: FIPVEVLVD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEQPXIPXEXLVXLFLKEGACDELF

SEQ ID NO: 348403 - protein, 25 aa, Artificial Sequence
  Description of Artificial Sequence: Synthetic peptide
  Seed: AEQPFIPVEVLVDLFLKEGACDELF (PRAME_HUMAN)
  Core: VEVLVDLFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPXEVXVXLFXKEGACDELF

SEQ ID NO: 348404 - protein, 25 aa, Artificial Sequence
  Description of Artificial Sequence: Synthetic peptide
  Seed: AEQPFIPVEVLVDLFLKEGACDELF (PRAME_HUMAN)
  Core: VLVDLFLKE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEQPFIPVEXLVXLXLKXGACDELF

SEQ ID NO: 348405 - protein, 14 aa, Artificial Sequence
  Description of Artificial Sequence: Synthetic peptide
  Seed: AFDGRHSQTLKAMV (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMV

SEQ ID NO: 348406 - protein, 15 aa, Artificial Sequence
  Description of Artificial Sequence: Synthetic peptide
  Seed: AFDGRHSQTLKAMVQ (PRAME_HUMAN)
  Core: FDGRHSQTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXDGXHXQTXKAMVQ

SEQ ID NO: 348407 - protein, 15 aa, Artificial Sequence
  Description of Artificial Sequence: Synthetic peptide
  Seed: AFDGRHSQTLKAMVQ (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQ

SEQ ID NO: 348408 - protein, 16 aa, Artificial Sequence
  Description of Artificial Sequence: Synthetic peptide
  Seed: AFDGRHSQTLKAMVQA (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQA

SEQ ID NO: 348409 - protein, 16 aa, Artificial Sequence
  Description of Artificial Sequence: Synthetic peptide
  Seed: AFDGRHSQTLKAMVQA (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXA

SEQ ID NO: 348410 - protein, 17 aa, Artificial Sequence
  Description of Artificial Sequence: Synthetic peptide
  Seed: AFDGRHSQTLKAMVQAW (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAW

SEQ ID NO: 348411 - protein, 17 aa, Artificial Sequence
  Description of Artificial Sequence: Synthetic peptide
  Seed: AFDGRHSQTLKAMVQAW (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAW

SEQ ID NO: 348412 - protein, 18 aa, Artificial Sequence
  Description of Artificial Sequence: Synthetic peptide
  Seed: AFDGRHSQTLKAMVQAWP (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWP

SEQ ID NO: 348413 - protein, 19 aa, Artificial Sequence
  Description of Artificial Sequence: Synthetic peptide
  Seed: AFDGRHSQTLKAMVQAWPF (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPF

SEQ ID NO: 348414 - protein, 19 aa, Artificial Sequence
  Description of Artificial Sequence: Synthetic peptide
  Seed: AFDGRHSQTLKAMVQAWPF (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPF

SEQ ID NO: 348415 - protein, 19 aa, Artificial Sequence
  Description of Artificial Sequence: Synthetic peptide
  Seed: AFDGRHSQTLKAMVQAWPF (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPF

SEQ ID NO: 348416 - protein, 19 aa, Artificial Sequence
  Description of Artificial Sequence: Synthetic peptide
  Seed: AFDGRHSQTLKAMVQAWPF (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXF

SEQ ID NO: 348417 - protein, 20 aa, Artificial Sequence
  Description of Artificial Sequence: Synthetic peptide
  Seed: AFDGRHSQTLKAMVQAWPFT (PRAME_HUMAN)
  Core: FDGRHSQTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXDGXHXQTXKAMVQAWPFT

SEQ ID NO: 348418 - protein, 20 aa, Artificial Sequence
  Description of Artificial Sequence: Synthetic peptide
  Seed: AFDGRHSQTLKAMVQAWPFT (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFT

SEQ ID NO: 348419 - protein, 20 aa, Artificial Sequence
  Description of Artificial Sequence: Synthetic peptide
  Seed: AFDGRHSQTLKAMVQAWPFT (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFT

SEQ ID NO: 348420 - protein, 20 aa, Artificial Sequence
  Description of Artificial Sequence: Synthetic peptide
  Seed: AFDGRHSQTLKAMVQAWPFT (PRAME_HUMAN)
  Core: HSQTLKAMV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRXSQXLXAMXQAWPFT

SEQ ID NO: 348421 - protein, 20 aa, Artificial Sequence
  Description of Artificial Sequence: Synthetic peptide
  Seed: AFDGRHSQTLKAMVQAWPFT (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFT

SEQ ID NO: 348422 - protein, 20 aa, Artificial Sequence
  Description of Artificial Sequence: Synthetic peptide
  Seed: AFDGRHSQTLKAMVQAWPFT (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFT

SEQ ID NO: 348423 - protein, 20 aa, Artificial Sequence
  Description of Artificial Sequence: Synthetic peptide
  Seed: AFDGRHSQTLKAMVQAWPFT (PRAME_HUMAN)
  Core: KAMVQAWPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLXAMXQXWPXT

SEQ ID NO: 348424 - protein, 21 aa, Artificial Sequence
  Description of Artificial Sequence: Synthetic peptide
  Seed: AFDGRHSQTLKAMVQAWPFTC (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFTC

SEQ ID NO: 348425 - protein, 21 aa, Artificial Sequence
  Description of Artificial Sequence: Synthetic peptide
  Seed: AFDGRHSQTLKAMVQAWPFTC (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFTC

SEQ ID NO: 348426 - protein, 21 aa, Artificial Sequence
  Description of Artificial Sequence: Synthetic peptide
  Seed: AFDGRHSQTLKAMVQAWPFTC (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFTC

SEQ ID NO: 348427 - protein, 21 aa, Artificial Sequence
  Description of Artificial Sequence: Synthetic peptide
  Seed: AFDGRHSQTLKAMVQAWPFTC (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFTC

SEQ ID NO: 348428 - protein, 22 aa, Artificial Sequence
  Description of Artificial Sequence: Synthetic peptide
  Seed: AFDGRHSQTLKAMVQAWPFTCL (PRAME_HUMAN)
  Core: FDGRHSQTL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXDGXHXQTXKAMVQAWPFTCL

SEQ ID NO: 348429 - protein, 22 aa, Artificial Sequence
  Description of Artificial Sequence: Synthetic peptide
  Seed: AFDGRHSQTLKAMVQAWPFTCL (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFTCL

SEQ ID NO: 348430 - protein, 22 aa, Artificial Sequence
  Description of Artificial Sequence: Synthetic peptide
  Seed: AFDGRHSQTLKAMVQAWPFTCL (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFTCL

SEQ ID NO: 348431 - protein, 22 aa, Artificial Sequence
  Description of Artificial Sequence: Synthetic peptide
  Seed: AFDGRHSQTLKAMVQAWPFTCL (PRAME_HUMAN)
  Core: HSQTLKAMV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRXSQXLXAMXQAWPFTCL

SEQ ID NO: 348432 - protein, 22 aa, Artificial Sequence
  Description of Artificial Sequence: Synthetic peptide
  Seed: AFDGRHSQTLKAMVQAWPFTCL (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFTCL

SEQ ID NO: 348433 - protein, 22 aa, Artificial Sequence
  Description of Artificial Sequence: Synthetic peptide
  Seed: AFDGRHSQTLKAMVQAWPFTCL (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFTCL

SEQ ID NO: 348434 - protein, 22 aa, Artificial Sequence
  Description of Artificial Sequence: Synthetic peptide
  Seed: AFDGRHSQTLKAMVQAWPFTCL (PRAME_HUMAN)
  Core: KAMVQAWPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLXAMXQXWPXTCL

SEQ ID NO: 348435 - protein, 23 aa, Artificial Sequence
  Description of Artificial Sequence: Synthetic peptide
  Seed: AFDGRHSQTLKAMVQAWPFTCLP (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFTCLP

SEQ ID NO: 348436 - protein, 23 aa, Artificial Sequence
  Description of Artificial Sequence: Synthetic peptide
  Seed: AFDGRHSQTLKAMVQAWPFTCLP (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFTCLP

SEQ ID NO: 348437 - protein, 23 aa, Artificial Sequence
  Description of Artificial Sequence: Synthetic peptide
  Seed: AFDGRHSQTLKAMVQAWPFTCLP (PRAME_HUMAN)
  Core: HSQTLKAMV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRXSQXLXAMXQAWPFTCLP

SEQ ID NO: 348438 - protein, 23 aa, Artificial Sequence
  Description of Artificial Sequence: Synthetic peptide
  Seed: AFDGRHSQTLKAMVQAWPFTCLP (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFTCLP

SEQ ID NO: 348439 - protein, 23 aa, Artificial Sequence
  Description of Artificial Sequence: Synthetic peptide
  Seed: AFDGRHSQTLKAMVQAWPFTCLP (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFTCLP

SEQ ID NO: 348440 - protein, 23 aa, Artificial Sequence
  Description of Artificial Sequence: Synthetic peptide
  Seed: AFDGRHSQTLKAMVQAWPFTCLP (PRAME_HUMAN)
  Core: KAMVQAWPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLXAMXQXWPXTCLP

SEQ ID NO: 348441 - protein, 23 aa, Artificial Sequence
  Description of Artificial Sequence: Synthetic peptide
  Seed: AFDGRHSQTLKAMVQAWPFTCLP (PRAME_HUMAN)
  Core: MVQAWPFTC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAXVQXWXFTXLP

SEQ ID NO: 348442 - protein, 23 aa, Artificial Sequence
  Description of Artificial Sequence: Synthetic peptide
  Seed: AFDGRHSQTLKAMVQAWPFTCLP (PRAME_HUMAN)
  Core: VQAWPFTCL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAMXQAXPXTCXP

SEQ ID NO: 348443 - protein, 24 aa, Artificial Sequence
  Description of Artificial Sequence: Synthetic peptide
  Seed: AFDGRHSQTLKAMVQAWPFTCLPL (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFTCLPL

SEQ ID NO: 348444 - protein, 24 aa, Artificial Sequence
  Description of Artificial Sequence: Synthetic peptide
  Seed: AFDGRHSQTLKAMVQAWPFTCLPL (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFTCLPL

SEQ ID NO: 348445 - protein, 24 aa, Artificial Sequence
  Description of Artificial Sequence: Synthetic peptide
  Seed: AFDGRHSQTLKAMVQAWPFTCLPL (PRAME_HUMAN)
  Core: HSQTLKAMV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRXSQXLXAMXQAWPFTCLPL

SEQ ID NO: 348446 - protein, 24 aa, Artificial Sequence
  Description of Artificial Sequence: Synthetic peptide
  Seed: AFDGRHSQTLKAMVQAWPFTCLPL (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFTCLPL

SEQ ID NO: 348447 - protein, 24 aa, Artificial Sequence
  Description of Artificial Sequence: Synthetic peptide
  Seed: AFDGRHSQTLKAMVQAWPFTCLPL (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFTCLPL

SEQ ID NO: 348448 - protein, 24 aa, Artificial Sequence
  Description of Artificial Sequence: Synthetic peptide
  Seed: AFDGRHSQTLKAMVQAWPFTCLPL (PRAME_HUMAN)
  Core: KAMVQAWPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLXAMXQXWPXTCLPL

SEQ ID NO: 348449 - protein, 24 aa, Artificial Sequence
  Description of Artificial Sequence: Synthetic peptide
  Seed: AFDGRHSQTLKAMVQAWPFTCLPL (PRAME_HUMAN)
  Core: MVQAWPFTC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAXVQXWXFTXLPL

SEQ ID NO: 348450 - protein, 24 aa, Artificial Sequence
  Description of Artificial Sequence: Synthetic peptide
  Seed: AFDGRHSQTLKAMVQAWPFTCLPL (PRAME_HUMAN)
  Core: VQAWPFTCL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAMXQAXPXTCXPL

SEQ ID NO: 348451 - protein, 25 aa, Artificial Sequence
  Description of Artificial Sequence: Synthetic peptide
  Seed: AFDGRHSQTLKAMVQAWPFTCLPLG (PRAME_HUMAN)
  Core: GRHSQTLKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFDXRHXQXLKXMVQAWPFTCLPLG

SEQ ID NO: 348452 - protein, 25 aa, Artificial Sequence
  Description of Artificial Sequence: Synthetic peptide
  Seed: AFDGRHSQTLKAMVQAWPFTCLPLG (PRAME_HUMAN)
  Core: RHSQTLKAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFDGXHSXTXKAXVQAWPFTCLPLG

SEQ ID NO: 348453 - protein, 25 aa, Artificial Sequence
  Description of Artificial Sequence: Synthetic peptide
  Seed: AFDGRHSQTLKAMVQAWPFTCLPLG (PRAME_HUMAN)
  Core: HSQTLKAMV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRXSQXLXAMXQAWPFTCLPLG

SEQ ID NO: 348454 - protein, 25 aa, Artificial Sequence
  Description of Artificial Sequence: Synthetic peptide
  Seed: AFDGRHSQTLKAMVQAWPFTCLPLG (PRAME_HUMAN)
  Core: SQTLKAMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHXQTXKXMVXAWPFTCLPLG

SEQ ID NO: 348455 - protein, 25 aa, Artificial Sequence
  Description of Artificial Sequence: Synthetic peptide
  Seed: AFDGRHSQTLKAMVQAWPFTCLPLG (PRAME_HUMAN)
  Core: LKAMVQAWP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTXKAXVXAWXFTCLPLG

SEQ ID NO: 348456 - protein, 25 aa, Artificial Sequence
  Description of Artificial Sequence: Synthetic peptide
  Seed: AFDGRHSQTLKAMVQAWPFTCLPLG (PRAME_HUMAN)
  Core: KAMVQAWPF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLXAMXQXWPXTCLPLG

SEQ ID NO: 348457 - protein, 25 aa, Artificial Sequence
  Description of Artificial Sequence: Synthetic peptide
  Seed: AFDGRHSQTLKAMVQAWPFTCLPLG (PRAME_HUMAN)
  Core: MVQAWPFTC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAXVQXWXFTXLPLG

SEQ ID NO: 348458 - protein, 25 aa, Artificial Sequence
  Description of Artificial Sequence: Synthetic peptide
  Seed: AFDGRHSQTLKAMVQAWPFTCLPLG (PRAME_HUMAN)
  Core: VQAWPFTCL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFDGRHSQTLKAMXQAXPXTCXPLG

SEQ ID NO: 348459 - protein, 13 aa, Artificial Sequence
  Description of Artificial Sequence: Synthetic peptide
  Seed: AGQSLLKDEALAI (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAX

SEQ ID NO: 348460 - protein, 14 aa, Artificial Sequence
  Description of Artificial Sequence: Synthetic peptide
  Seed: AGQSLLKDEALAIA (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIA

SEQ ID NO: 348461 - protein, 14 aa, Artificial Sequence
  Description of Artificial Sequence: Synthetic peptide
  Seed: AGQSLLKDEALAIA (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXA

SEQ ID NO: 348462 - protein, 15 aa, Artificial Sequence
  Description of Artificial Sequence: Synthetic peptide
  Seed: AGQSLLKDEALAIAA (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAA

SEQ ID NO: 348463 - protein, 15 aa, Artificial Sequence
  Description of Artificial Sequence: Synthetic peptide
  Seed: AGQSLLKDEALAIAA (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAA

SEQ ID NO: 348464 - protein, 15 aa, Artificial Sequence
  Description of Artificial Sequence: Synthetic peptide
  Seed: AGQSLLKDEALAIAA (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXA

SEQ ID NO: 348465 - protein, 16 aa, Artificial Sequence
  Description of Artificial Sequence: Synthetic peptide
  Seed: AGQSLLKDEALAIAAL (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAAL

SEQ ID NO: 348466 - protein, 16 aa, Artificial Sequence
  Description of Artificial Sequence: Synthetic peptide
  Seed: AGQSLLKDEALAIAAL (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAAL

SEQ ID NO: 348467 - protein, 16 aa, Artificial Sequence
  Description of Artificial Sequence: Synthetic peptide
  Seed: AGQSLLKDEALAIAAL (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXAL

SEQ ID NO: 348468 - protein, 17 aa, Artificial Sequence
  Description of Artificial Sequence: Synthetic peptide
  Seed: AGQSLLKDEALAIAALE (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAALE

SEQ ID NO: 348469 - protein, 17 aa, Artificial Sequence
  Description of Artificial Sequence: Synthetic peptide
  Seed: AGQSLLKDEALAIAALE (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALE

SEQ ID NO: 348470 - protein, 17 aa, Artificial Sequence
  Description of Artificial Sequence: Synthetic peptide
  Seed: AGQSLLKDEALAIAALE (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALE

SEQ ID NO: 348471 - protein, 17 aa, Artificial Sequence
  Description of Artificial Sequence: Synthetic peptide
  Seed: AGQSLLKDEALAIAALE (PRAME_HUMAN)
  Core: KDEALAIAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLXDEXLXIAXLE

SEQ ID NO: 348472 - protein, 18 aa, Artificial Sequence
  Description of Artificial Sequence: Synthetic peptide
  Seed: AGQSLLKDEALAIAALEL (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAALEL

SEQ ID NO: 348473 - protein, 18 aa, Artificial Sequence
  Description of Artificial Sequence: Synthetic peptide
  Seed: AGQSLLKDEALAIAALEL (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALEL

SEQ ID NO: 348474 - protein, 18 aa, Artificial Sequence
  Description of Artificial Sequence: Synthetic peptide
  Seed: AGQSLLKDEALAIAALEL (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALEL

SEQ ID NO: 348475 - protein, 18 aa, Artificial Sequence
  Description of Artificial Sequence: Synthetic peptide
  Seed: AGQSLLKDEALAIAALEL (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXL

SEQ ID NO: 348476 - protein, 19 aa, Artificial Sequence
  Description of Artificial Sequence: Synthetic peptide
  Seed: AGQSLLKDEALAIAALELL (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAALELL

SEQ ID NO: 348477 - protein, 19 aa, Artificial Sequence
  Description of Artificial Sequence: Synthetic peptide
  Seed: AGQSLLKDEALAIAALELL (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELL

SEQ ID NO: 348478 - protein, 19 aa, Artificial Sequence
  Description of Artificial Sequence: Synthetic peptide
  Seed: AGQSLLKDEALAIAALELL (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELL

SEQ ID NO: 348479 - protein, 19 aa, Artificial Sequence
  Description of Artificial Sequence: Synthetic peptide
  Seed: AGQSLLKDEALAIAALELL (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLL

SEQ ID NO: 348480 - protein, 20 aa, Artificial Sequence
  Description of Artificial Sequence: Synthetic peptide
  Seed: AGQSLLKDEALAIAALELLP (PRAME_HUMAN)
  Core: QSLLKDEAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXSLXKXEAXAIAALELLP

SEQ ID NO: 348481 - protein, 20 aa, Artificial Sequence
  Description of Artificial Sequence: Synthetic peptide
  Seed: AGQSLLKDEALAIAALELLP (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLP

SEQ ID NO: 348482 - protein, 20 aa, Artificial Sequence
  Description of Artificial Sequence: Synthetic peptide
  Seed: AGQSLLKDEALAIAALELLP (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLP

SEQ ID NO: 348483 - protein, 20 aa, Artificial Sequence
  Description of Artificial Sequence: Synthetic peptide
  Seed: AGQSLLKDEALAIAALELLP (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLP

SEQ ID NO: 348484 - protein, 20 aa, Artificial Sequence
  Description of Artificial Sequence: Synthetic peptide
  Seed: AGQSLLKDEALAIAALELLP (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLP

SEQ ID NO: 348485 - protein, 21 aa, Artificial Sequence
  Description of Artificial Sequence: Synthetic peptide
  Seed: AGQSLLKDEALAIAALELLPR (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLPR

SEQ ID NO: 348486 - protein, 21 aa, Artificial Sequence
  Description of Artificial Sequence: Synthetic peptide
  Seed: AGQSLLKDEALAIAALELLPR (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLPR

SEQ ID NO: 348487 - protein, 21 aa, Artificial Sequence
  Description of Artificial Sequence: Synthetic peptide
  Seed: AGQSLLKDEALAIAALELLPR (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLPR

SEQ ID NO: 348488 - protein, 21 aa, Artificial Sequence
  Description of Artificial Sequence: Synthetic peptide
  Seed: AGQSLLKDEALAIAALELLPR (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLPR

SEQ ID NO: 348489 - protein, 21 aa, Artificial Sequence
  Description of Artificial Sequence: Synthetic peptide
  Seed: AGQSLLKDEALAIAALELLPR (PRAME_HUMAN)
  Core: LAIAALELL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEAXAIXAXELXPR

SEQ ID NO: 348490 - protein, 22 aa, Artificial Sequence
  Description of Artificial Sequence: Synthetic peptide
  Seed: AGQSLLKDEALAIAALELLPRE (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLPRE

SEQ ID NO: 348491 - protein, 22 aa, Artificial Sequence
  Description of Artificial Sequence: Synthetic peptide
  Seed: AGQSLLKDEALAIAALELLPRE (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLPRE

SEQ ID NO: 348492 - protein, 22 aa, Artificial Sequence
  Description of Artificial Sequence: Synthetic peptide
  Seed: AGQSLLKDEALAIAALELLPRE (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLPRE

SEQ ID NO: 348493 - protein, 22 aa, Artificial Sequence
  Description of Artificial Sequence: Synthetic peptide
  Seed: AGQSLLKDEALAIAALELLPRE (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLPRE

SEQ ID NO: 348494 - protein, 22 aa, Artificial Sequence
  Description of Artificial Sequence: Synthetic peptide
  Seed: AGQSLLKDEALAIAALELLPRE (PRAME_HUMAN)
  Core: LAIAALELL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEAXAIXAXELXPRE

SEQ ID NO: 348495 - protein, 22 aa, Artificial Sequence
  Description of Artificial Sequence: Synthetic peptide
  Seed: AGQSLLKDEALAIAALELLPRE (PRAME_HUMAN)
  Core: IAALELLPR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEALAXAAXEXLPXE

SEQ ID NO: 348496 - protein, 23 aa, Artificial Sequence
  Description of Artificial Sequence: Synthetic peptide
  Seed: AGQSLLKDEALAIAALELLPREL (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLPREL

SEQ ID NO: 348497 - protein, 23 aa, Artificial Sequence
  Description of Artificial Sequence: Synthetic peptide
  Seed: AGQSLLKDEALAIAALELLPREL (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLPREL

SEQ ID NO: 348498 - protein, 23 aa, Artificial Sequence
  Description of Artificial Sequence: Synthetic peptide
  Seed: AGQSLLKDEALAIAALELLPREL (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLPREL

SEQ ID NO: 348499 - protein, 23 aa, Artificial Sequence
  Description of Artificial Sequence: Synthetic peptide
  Seed: AGQSLLKDEALAIAALELLPREL (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLPREL

SEQ ID NO: 348500 - protein, 23 aa, Artificial Sequence
  Description of Artificial Sequence: Synthetic peptide
  Seed: AGQSLLKDEALAIAALELLPREL (PRAME_HUMAN)
  Core: LAIAALELL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEAXAIXAXELXPREL

SEQ ID NO: 348501 - protein, 23 aa, Artificial Sequence
  Description of Artificial Sequence: Synthetic peptide
  Seed: AGQSLLKDEALAIAALELLPREL (PRAME_HUMAN)
  Core: IAALELLPR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEALAXAAXEXLPXEL

SEQ ID NO: 348502 - protein, 24 aa, Artificial Sequence
  Description of Artificial Sequence: Synthetic peptide
  Seed: AGQSLLKDEALAIAALELLPRELF (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLPRELF

SEQ ID NO: 348503 - protein, 24 aa, Artificial Sequence
  Description of Artificial Sequence: Synthetic peptide
  Seed: AGQSLLKDEALAIAALELLPRELF (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLPRELF

SEQ ID NO: 348504 - protein, 24 aa, Artificial Sequence
  Description of Artificial Sequence: Synthetic peptide
  Seed: AGQSLLKDEALAIAALELLPRELF (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLPRELF

SEQ ID NO: 348505 - protein, 24 aa, Artificial Sequence
  Description of Artificial Sequence: Synthetic peptide
  Seed: AGQSLLKDEALAIAALELLPRELF (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLPRELF

SEQ ID NO: 348506 - protein, 24 aa, Artificial Sequence
  Description of Artificial Sequence: Synthetic peptide
  Seed: AGQSLLKDEALAIAALELLPRELF (PRAME_HUMAN)
  Core: LAIAALELL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEAXAIXAXELXPRELF

SEQ ID NO: 348507 - protein, 24 aa, Artificial Sequence
  Description of Artificial Sequence: Synthetic peptide
  Seed: AGQSLLKDEALAIAALELLPRELF (PRAME_HUMAN)
  Core: IAALELLPR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEALAXAAXEXLPXELF

SEQ ID NO: 348508 - protein, 25 aa, Artificial Sequence
  Description of Artificial Sequence: Synthetic peptide
  Seed: AGQSLLKDEALAIAALELLPRELFP (PRAME_HUMAN)
  Core: LLKDEALAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGQSXLKXEXLAXAALELLPRELFP

SEQ ID NO: 348509 - protein, 25 aa, Artificial Sequence
  Description of Artificial Sequence: Synthetic peptide
  Seed: AGQSLLKDEALAIAALELLPRELFP (PRAME_HUMAN)
  Core: LKDEALAIA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLXKDXAXAIXALELLPRELFP

SEQ ID NO: 348510 - protein, 25 aa, Artificial Sequence
  Description of Artificial Sequence: Synthetic peptide
  Seed: AGQSLLKDEALAIAALELLPRELFP (PRAME_HUMAN)
  Core: EALAIAALE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDXALXIXALXLLPRELFP

SEQ ID NO: 348511 - protein, 25 aa, Artificial Sequence
  Description of Artificial Sequence: Synthetic peptide
  Seed: AGQSLLKDEALAIAALELLPRELFP (PRAME_HUMAN)
  Core: ALAIAALEL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEXLAXAXLEXLPRELFP

SEQ ID NO: 348512 - protein, 25 aa, Artificial Sequence
  Description of Artificial Sequence: Synthetic peptide
  Seed: AGQSLLKDEALAIAALELLPRELFP (PRAME_HUMAN)
  Core: LAIAALELL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEAXAIXAXELXPRELFP

SEQ ID NO: 348513 - protein, 25 aa, Artificial Sequence
  Description of Artificial Sequence: Synthetic peptide
  Seed: AGQSLLKDEALAIAALELLPRELFP (PRAME_HUMAN)
  Core: IAALELLPR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEALAXAAXEXLPXELFP

SEQ ID NO: 348514 - protein, 25 aa, Artificial Sequence
  Description of Artificial Sequence: Synthetic peptide
  Seed: AGQSLLKDEALAIAALELLPRELFP (PRAME_HUMAN)
  Core: LELLPRELF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AGQSLLKDEALAIAAXELXPXELXP

SEQ ID NO: 348515 - protein, 13 aa, Artificial Sequence
  Description of Artificial Sequence: Synthetic peptide
  Seed: AIAALELLPRELF (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELF

SEQ ID NO: 348516 - protein, 14 aa, Artificial Sequence
  Description of Artificial Sequence: Synthetic peptide
  Seed: AIAALELLPRELFP (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFP

SEQ ID NO: 348517 - protein, 14 aa, Artificial Sequence
  Description of Artificial Sequence: Synthetic peptide
  Seed: AIAALELLPRELFP (PRAME_HUMAN)
  Core: AALELLPRE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AIXALXLXPRXLFP

SEQ ID NO: 348518 - protein, 14 aa, Artificial Sequence
  Description of Artificial Sequence: Synthetic peptide
  Seed: AIAALELLPRELFP (PRAME_HUMAN)
  Core: ALELLPREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIAXLEXLXREXFP

SEQ ID NO: 348519 - protein, 14 aa, Artificial Sequence
  Description of Artificial Sequence: Synthetic peptide
  Seed: AIAALELLPRELFP (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXP

SEQ ID NO: 348520 - protein, 15 aa, Artificial Sequence
  Description of Artificial Sequence: Synthetic peptide
  Seed: AIAALELLPRELFPP (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPP

SEQ ID NO: 348521 - protein, 15 aa, Artificial Sequence
  Description of Artificial Sequence: Synthetic peptide
  Seed: AIAALELLPRELFPP (PRAME_HUMAN)
  Core: ALELLPREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIAXLEXLXREXFPP

SEQ ID NO: 348522 - protein, 15 aa, Artificial Sequence
  Description of Artificial Sequence: Synthetic peptide
  Seed: AIAALELLPRELFPP (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPP

SEQ ID NO: 348523 - protein, 16 aa, Artificial Sequence
  Description of Artificial Sequence: Synthetic peptide
  Seed: AIAALELLPRELFPPL (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPL

SEQ ID NO: 348524 - protein, 16 aa, Artificial Sequence
  Description of Artificial Sequence: Synthetic peptide
  Seed: AIAALELLPRELFPPL (PRAME_HUMAN)
  Core: ALELLPREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIAXLEXLXREXFPPL

SEQ ID NO: 348525 - protein, 16 aa, Artificial Sequence
  Description of Artificial Sequence: Synthetic peptide
  Seed: AIAALELLPRELFPPL (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPL

SEQ ID NO: 348526 - protein, 17 aa, Artificial Sequence
  Description of Artificial Sequence: Synthetic peptide
  Seed: AIAALELLPRELFPPLF (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLF

SEQ ID NO: 348527 - protein, 17 aa, Artificial Sequence
  Description of Artificial Sequence: Synthetic peptide
  Seed: AIAALELLPRELFPPLF (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLF

SEQ ID NO: 348528 - protein, 17 aa, Artificial Sequence
  Description of Artificial Sequence: Synthetic peptide
  Seed: AIAALELLPRELFPPLF (PRAME_HUMAN)
  Core: LLPRELFPP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIAALEXLPXEXFPXLF

SEQ ID NO: 348529 - protein, 18 aa, Artificial Sequence
  Description of Artificial Sequence: Synthetic peptide
  Seed: AIAALELLPRELFPPLFM (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFM

SEQ ID NO: 348530 - protein, 18 aa, Artificial Sequence
  Description of Artificial Sequence: Synthetic peptide
  Seed: AIAALELLPRELFPPLFM (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFM

SEQ ID NO: 348531 - protein, 19 aa, Artificial Sequence
  Description of Artificial Sequence: Synthetic peptide
  Seed: AIAALELLPRELFPPLFMA (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMA

SEQ ID NO: 348532 - protein, 19 aa, Artificial Sequence
  Description of Artificial Sequence: Synthetic peptide
  Seed: AIAALELLPRELFPPLFMA (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMA

SEQ ID NO: 348533 - protein, 19 aa, Artificial Sequence
  Description of Artificial Sequence: Synthetic peptide
  Seed: AIAALELLPRELFPPLFMA (PRAME_HUMAN)
  Core: LLPRELFPP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIAALEXLPXEXFPXLFMA

SEQ ID NO: 348534 - protein, 19 aa, Artificial Sequence
  Description of Artificial Sequence: Synthetic peptide
  Seed: AIAALELLPRELFPPLFMA (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXA

SEQ ID NO: 348535 - protein, 20 aa, Artificial Sequence
  Description of Artificial Sequence: Synthetic peptide
  Seed: AIAALELLPRELFPPLFMAA (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMAA

SEQ ID NO: 348536 - protein, 20 aa, Artificial Sequence
  Description of Artificial Sequence: Synthetic peptide
  Seed: AIAALELLPRELFPPLFMAA (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAA

SEQ ID NO: 348537 - protein, 20 aa, Artificial Sequence
  Description of Artificial Sequence: Synthetic peptide
  Seed: AIAALELLPRELFPPLFMAA (PRAME_HUMAN)
  Core: LLPRELFPP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIAALEXLPXEXFPXLFMAA

SEQ ID NO: 348538 - protein, 20 aa, Artificial Sequence
  Description of Artificial Sequence: Synthetic peptide
  Seed: AIAALELLPRELFPPLFMAA (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAA

SEQ ID NO: 348539 - protein, 20 aa, Artificial Sequence
  Description of Artificial Sequence: Synthetic peptide
  Seed: AIAALELLPRELFPPLFMAA (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAA

SEQ ID NO: 348540 - protein, 20 aa, Artificial Sequence
  Description of Artificial Sequence: Synthetic peptide
  Seed: AIAALELLPRELFPPLFMAA (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAX

SEQ ID NO: 348541 - protein, 21 aa, Artificial Sequence
  Description of Artificial Sequence: Synthetic peptide
  Seed: AIAALELLPRELFPPLFMAAF (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMAAF

SEQ ID NO: 348542 - protein, 21 aa, Artificial Sequence
  Description of Artificial Sequence: Synthetic peptide
  Seed: AIAALELLPRELFPPLFMAAF (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAAF

SEQ ID NO: 348543 - protein, 21 aa, Artificial Sequence
  Description of Artificial Sequence: Synthetic peptide
  Seed: AIAALELLPRELFPPLFMAAF (PRAME_HUMAN)
  Core: LLPRELFPP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AIAALEXLPXEXFPXLFMAAF

SEQ ID NO: 348544 - protein, 21 aa, Artificial Sequence
  Description of Artificial Sequence: Synthetic peptide
  Seed: AIAALELLPRELFPPLFMAAF (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAAF

SEQ ID NO: 348545 - protein, 21 aa, Artificial Sequence
  Description of Artificial Sequence: Synthetic peptide
  Seed: AIAALELLPRELFPPLFMAAF (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAAF

SEQ ID NO: 348546 - protein, 21 aa, Artificial Sequence
  Description of Artificial Sequence: Synthetic peptide
  Seed: AIAALELLPRELFPPLFMAAF (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAXF

SEQ ID NO: 348547 - protein, 22 aa, Artificial Sequence
  Description of Artificial Sequence: Synthetic peptide
  Seed: AIAALELLPRELFPPLFMAAFD (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMAAFD

SEQ ID NO: 348548 - protein, 22 aa, Artificial Sequence
  Description of Artificial Sequence: Synthetic peptide
  Seed: AIAALELLPRELFPPLFMAAFD (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAAFD

SEQ ID NO: 348549 - protein, 22 aa, Artificial Sequence
  Description of Artificial Sequence: Synthetic peptide
  Seed: AIAALELLPRELFPPLFMAAFD (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAAFD

SEQ ID NO: 348550 - protein, 22 aa, Artificial Sequence
  Description of Artificial Sequence: Synthetic peptide
  Seed: AIAALELLPRELFPPLFMAAFD (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAAFD

SEQ ID NO: 348551 - protein, 22 aa, Artificial Sequence
  Description of Artificial Sequence: Synthetic peptide
  Seed: AIAALELLPRELFPPLFMAAFD (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAXFD

SEQ ID NO: 348552 - protein, 23 aa, Artificial Sequence
  Description of Artificial Sequence: Synthetic peptide
  Seed: AIAALELLPRELFPPLFMAAFDG (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMAAFDG

SEQ ID NO: 348553 - protein, 23 aa, Artificial Sequence
  Description of Artificial Sequence: Synthetic peptide
  Seed: AIAALELLPRELFPPLFMAAFDG (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAAFDG

SEQ ID NO: 348554 - protein, 23 aa, Artificial Sequence
  Description of Artificial Sequence: Synthetic peptide
  Seed: AIAALELLPRELFPPLFMAAFDG (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAAFDG

SEQ ID NO: 348555 - protein, 23 aa, Artificial Sequence
  Description of Artificial Sequence: Synthetic peptide
  Seed: AIAALELLPRELFPPLFMAAFDG (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAAFDG

SEQ ID NO: 348556 - protein, 23 aa, Artificial Sequence
  Description of Artificial Sequence: Synthetic peptide
  Seed: AIAALELLPRELFPPLFMAAFDG (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAXFDG

SEQ ID NO: 348557 - protein, 24 aa, Artificial Sequence
  Description of Artificial Sequence: Synthetic peptide
  Seed: AIAALELLPRELFPPLFMAAFDGR (PRAME_HUMAN)
  Core: IAALELLPR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXAAXEXLPXELFPPLFMAAFDGR

SEQ ID NO: 348558 - protein, 24 aa, Artificial Sequence
  Description of Artificial Sequence: Synthetic peptide
  Seed: AIAALELLPRELFPPLFMAAFDGR (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAAFDGR

SEQ ID NO: 348559 - protein, 24 aa, Artificial Sequence
  Description of Artificial Sequence: Synthetic peptide
  Seed: AIAALELLPRELFPPLFMAAFDGR (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAAFDGR

SEQ ID NO: 348560 - protein, 24 aa, Artificial Sequence
  Description of Artificial Sequence: Synthetic peptide
  Seed: AIAALELLPRELFPPLFMAAFDGR (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAAFDGR

SEQ ID NO: 348561 - protein, 24 aa, Artificial Sequence
  Description of Artificial Sequence: Synthetic peptide
  Seed: AIAALELLPRELFPPLFMAAFDGR (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAXFDGR

SEQ ID NO: 348562 - protein, 25 aa, Artificial Sequence
  Description of Artificial Sequence: Synthetic peptide
  Seed: AIAALELLPRELFPPLFMAAFDGRH (PRAME_HUMAN)
  Core: LELLPRELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AIAAXELXPXELXPPLFMAAFDGRH

SEQ ID NO: 348563 - protein, 25 aa, Artificial Sequence
  Description of Artificial Sequence: Synthetic peptide
  Seed: AIAALELLPRELFPPLFMAAFDGRH (PRAME_HUMAN)
  Core: PRELFPPLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLXREXFXPLXMAAFDGRH

SEQ ID NO: 348564 - protein, 25 aa, Artificial Sequence
  Description of Artificial Sequence: Synthetic peptide
  Seed: AIAALELLPRELFPPLFMAAFDGRH (PRAME_HUMAN)
  Core: RELFPPLFM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPXELXPXLFXAAFDGRH

SEQ ID NO: 348565 - protein, 25 aa, Artificial Sequence
  Description of Artificial Sequence: Synthetic peptide
  Seed: AIAALELLPRELFPPLFMAAFDGRH (PRAME_HUMAN)
  Core: LFPPLFMAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPREXFPXLXMAXFDGRH

SEQ ID NO: 348566 - protein, 25 aa, Artificial Sequence
  Description of Artificial Sequence: Synthetic peptide
  Seed: AIAALELLPRELFPPLFMAAFDGRH (PRAME_HUMAN)
  Core: PLFMAAFDG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPRELFPXLFXAXFDXRH

SEQ ID NO: 348567 - protein, 25 aa, Artificial Sequence
  Description of Artificial Sequence: Synthetic peptide
  Seed: AIAALELLPRELFPPLFMAAFDGRH (PRAME_HUMAN)
  Core: FMAAFDGRH
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
AIAALELLPRELFPPLXMAXFXGRX

SEQ ID NO: 348568 - protein, 13 aa, Artificial Sequence
  Description of Artificial Sequence: Synthetic peptide
  Seed: AKFSPYLGQMINL (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNL

SEQ ID NO: 348569 - protein, 14 aa, Artificial Sequence
  Description of Artificial Sequence: Synthetic peptide
  Seed: AKFSPYLGQMINLR (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLR

SEQ ID NO: 348570 - protein, 14 aa, Artificial Sequence
  Description of Artificial Sequence: Synthetic peptide
  Seed: AKFSPYLGQMINLR (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLX

SEQ ID NO: 348571 - protein, 15 aa, Artificial Sequence
  Description of Artificial Sequence: Synthetic peptide
  Seed: AKFSPYLGQMINLRR (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRR

SEQ ID NO: 348572 - protein, 15 aa, Artificial Sequence
  Description of Artificial Sequence: Synthetic peptide
  Seed: AKFSPYLGQMINLRR (PRAME_HUMAN)
  Core: PYLGQMINL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AKFSXYLXQXINXRR

SEQ ID NO: 348573 - protein, 15 aa, Artificial Sequence
  Description of Artificial Sequence: Synthetic peptide
  Seed: AKFSPYLGQMINLRR (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXR

SEQ ID NO: 348574 - protein, 15 aa, Artificial Sequence
  Description of Artificial Sequence: Synthetic peptide
  Seed: AKFSPYLGQMINLRR (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRX

SEQ ID NO: 348575 - protein, 16 aa, Artificial Sequence
  Description of Artificial Sequence: Synthetic peptide
  Seed: AKFSPYLGQMINLRRL (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRL

SEQ ID NO: 348576 - protein, 16 aa, Artificial Sequence
  Description of Artificial Sequence: Synthetic peptide
  Seed: AKFSPYLGQMINLRRL (PRAME_HUMAN)
  Core: PYLGQMINL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AKFSXYLXQXINXRRL

SEQ ID NO: 348577 - protein, 16 aa, Artificial Sequence
  Description of Artificial Sequence: Synthetic peptide
  Seed: AKFSPYLGQMINLRRL (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRL

SEQ ID NO: 348578 - protein, 16 aa, Artificial Sequence
  Description of Artificial Sequence: Synthetic peptide
  Seed: AKFSPYLGQMINLRRL (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXL

SEQ ID NO: 348579 - protein, 17 aa, Artificial Sequence
  Description of Artificial Sequence: Synthetic peptide
  Seed: AKFSPYLGQMINLRRLL (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLL

SEQ ID NO: 348580 - protein, 17 aa, Artificial Sequence
  Description of Artificial Sequence: Synthetic peptide
  Seed: AKFSPYLGQMINLRRLL (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLL

SEQ ID NO: 348581 - protein, 17 aa, Artificial Sequence
  Description of Artificial Sequence: Synthetic peptide
  Seed: AKFSPYLGQMINLRRLL (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLL

SEQ ID NO: 348582 - protein, 18 aa, Artificial Sequence
  Description of Artificial Sequence: Synthetic peptide
  Seed: AKFSPYLGQMINLRRLLL (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLL

SEQ ID NO: 348583 - protein, 18 aa, Artificial Sequence
  Description of Artificial Sequence: Synthetic peptide
  Seed: AKFSPYLGQMINLRRLLL (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLL

SEQ ID NO: 348584 - protein, 18 aa, Artificial Sequence
  Description of Artificial Sequence: Synthetic peptide
  Seed: AKFSPYLGQMINLRRLLL (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLL

SEQ ID NO: 348585 - protein, 18 aa, Artificial Sequence
  Description of Artificial Sequence: Synthetic peptide
  Seed: AKFSPYLGQMINLRRLLL (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLX

SEQ ID NO: 348586 - protein, 19 aa, Artificial Sequence
  Description of Artificial Sequence: Synthetic peptide
  Seed: AKFSPYLGQMINLRRLLLS (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLS

SEQ ID NO: 348587 - protein, 19 aa, Artificial Sequence
  Description of Artificial Sequence: Synthetic peptide
  Seed: AKFSPYLGQMINLRRLLLS (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLS

SEQ ID NO: 348588 - protein, 19 aa, Artificial Sequence
  Description of Artificial Sequence: Synthetic peptide
  Seed: AKFSPYLGQMINLRRLLLS (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLS

SEQ ID NO: 348589 - protein, 19 aa, Artificial Sequence
  Description of Artificial Sequence: Synthetic peptide
  Seed: AKFSPYLGQMINLRRLLLS (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXS

SEQ ID NO: 348590 - protein, 20 aa, Artificial Sequence
  Description of Artificial Sequence: Synthetic peptide
  Seed: AKFSPYLGQMINLRRLLLSH (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSH

SEQ ID NO: 348591 - protein, 20 aa, Artificial Sequence
  Description of Artificial Sequence: Synthetic peptide
  Seed: AKFSPYLGQMINLRRLLLSH (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSH

SEQ ID NO: 348592 - protein, 20 aa, Artificial Sequence
  Description of Artificial Sequence: Synthetic peptide
  Seed: AKFSPYLGQMINLRRLLLSH (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSH

SEQ ID NO: 348593 - protein, 20 aa, Artificial Sequence
  Description of Artificial Sequence: Synthetic peptide
  Seed: AKFSPYLGQMINLRRLLLSH (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSH

SEQ ID NO: 348594 - protein, 20 aa, Artificial Sequence
  Description of Artificial Sequence: Synthetic peptide
  Seed: AKFSPYLGQMINLRRLLLSH (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXH

SEQ ID NO: 348595 - protein, 21 aa, Artificial Sequence
  Description of Artificial Sequence: Synthetic peptide
  Seed: AKFSPYLGQMINLRRLLLSHI (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSHI

SEQ ID NO: 348596 - protein, 21 aa, Artificial Sequence
  Description of Artificial Sequence: Synthetic peptide
  Seed: AKFSPYLGQMINLRRLLLSHI (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSHI

SEQ ID NO: 348597 - protein, 21 aa, Artificial Sequence
  Description of Artificial Sequence: Synthetic peptide
  Seed: AKFSPYLGQMINLRRLLLSHI (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSHI

SEQ ID NO: 348598 - protein, 21 aa, Artificial Sequence
  Description of Artificial Sequence: Synthetic peptide
  Seed: AKFSPYLGQMINLRRLLLSHI (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSHI

SEQ ID NO: 348599 - protein, 21 aa, Artificial Sequence
  Description of Artificial Sequence: Synthetic peptide
  Seed: AKFSPYLGQMINLRRLLLSHI (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXHI

SEQ ID NO: 348600 - protein, 22 aa, Artificial Sequence
  Description of Artificial Sequence: Synthetic peptide
  Seed: AKFSPYLGQMINLRRLLLSHIH (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSHIH

SEQ ID NO: 348601 - protein, 22 aa, Artificial Sequence
  Description of Artificial Sequence: Synthetic peptide
  Seed: AKFSPYLGQMINLRRLLLSHIH (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSHIH

SEQ ID NO: 348602 - protein, 22 aa, Artificial Sequence
  Description of Artificial Sequence: Synthetic peptide
  Seed: AKFSPYLGQMINLRRLLLSHIH (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSHIH

SEQ ID NO: 348603 - protein, 22 aa, Artificial Sequence
  Description of Artificial Sequence: Synthetic peptide
  Seed: AKFSPYLGQMINLRRLLLSHIH (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSHIH

SEQ ID NO: 348604 - protein, 22 aa, Artificial Sequence
  Description of Artificial Sequence: Synthetic peptide
  Seed: AKFSPYLGQMINLRRLLLSHIH (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXHIH

SEQ ID NO: 348605 - protein, 22 aa, Artificial Sequence
  Description of Artificial Sequence: Synthetic peptide
  Seed: AKFSPYLGQMINLRRLLLSHIH (PRAME_HUMAN)
  Core: LRRLLLSHI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINXRRXLXSHXH

SEQ ID NO: 348606 - protein, 22 aa, Artificial Sequence
  Description of Artificial Sequence: Synthetic peptide
  Seed: AKFSPYLGQMINLRRLLLSHIH (PRAME_HUMAN)
  Core: RRLLLSHIH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLXRLXLXHIX

SEQ ID NO: 348607 - protein, 23 aa, Artificial Sequence
  Description of Artificial Sequence: Synthetic peptide
  Seed: AKFSPYLGQMINLRRLLLSHIHA (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSHIHA

SEQ ID NO: 348608 - protein, 23 aa, Artificial Sequence
  Description of Artificial Sequence: Synthetic peptide
  Seed: AKFSPYLGQMINLRRLLLSHIHA (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSHIHA

SEQ ID NO: 348609 - protein, 23 aa, Artificial Sequence
  Description of Artificial Sequence: Synthetic peptide
  Seed: AKFSPYLGQMINLRRLLLSHIHA (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSHIHA

SEQ ID NO: 348610 - protein, 23 aa, Artificial Sequence
  Description of Artificial Sequence: Synthetic peptide
  Seed: AKFSPYLGQMINLRRLLLSHIHA (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSHIHA

SEQ ID NO: 348611 - protein, 23 aa, Artificial Sequence
  Description of Artificial Sequence: Synthetic peptide
  Seed: AKFSPYLGQMINLRRLLLSHIHA (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXHIHA

SEQ ID NO: 348612 - protein, 23 aa, Artificial Sequence
  Description of Artificial Sequence: Synthetic peptide
  Seed: AKFSPYLGQMINLRRLLLSHIHA (PRAME_HUMAN)
  Core: LRRLLLSHI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINXRRXLXSHXHA

SEQ ID NO: 348613 - protein, 23 aa, Artificial Sequence
  Description of Artificial Sequence: Synthetic peptide
  Seed: AKFSPYLGQMINLRRLLLSHIHA (PRAME_HUMAN)
  Core: RRLLLSHIH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLXRLXLXHIXA

SEQ ID NO: 348614 - protein, 24 aa, Artificial Sequence
  Description of Artificial Sequence: Synthetic peptide
  Seed: AKFSPYLGQMINLRRLLLSHIHAS (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSHIHAS

SEQ ID NO: 348615 - protein, 24 aa, Artificial Sequence
  Description of Artificial Sequence: Synthetic peptide
  Seed: AKFSPYLGQMINLRRLLLSHIHAS (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSHIHAS

SEQ ID NO: 348616 - protein, 24 aa, Artificial Sequence
  Description of Artificial Sequence: Synthetic peptide
  Seed: AKFSPYLGQMINLRRLLLSHIHAS (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSHIHAS

SEQ ID NO: 348617 - protein, 24 aa, Artificial Sequence
  Description of Artificial Sequence: Synthetic peptide
  Seed: AKFSPYLGQMINLRRLLLSHIHAS (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSHIHAS

SEQ ID NO: 348618 - protein, 24 aa, Artificial Sequence
  Description of Artificial Sequence: Synthetic peptide
  Seed: AKFSPYLGQMINLRRLLLSHIHAS (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXHIHAS

SEQ ID NO: 348619 - protein, 24 aa, Artificial Sequence
  Description of Artificial Sequence: Synthetic peptide
  Seed: AKFSPYLGQMINLRRLLLSHIHAS (PRAME_HUMAN)
  Core: LRRLLLSHI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINXRRXLXSHXHAS

SEQ ID NO: 348620 - protein, 24 aa, Artificial Sequence
  Description of Artificial Sequence: Synthetic peptide
  Seed: AKFSPYLGQMINLRRLLLSHIHAS (PRAME_HUMAN)
  Core: RRLLLSHIH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLXRLXLXHIXAS

SEQ ID NO: 348621 - protein, 24 aa, Artificial Sequence
  Description of Artificial Sequence: Synthetic peptide
  Seed: AKFSPYLGQMINLRRLLLSHIHAS (PRAME_HUMAN)
  Core: RLLLSHIHA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLRXLLXSXIHXS

SEQ ID NO: 348622 - protein, 24 aa, Artificial Sequence
  Description of Artificial Sequence: Synthetic peptide
  Seed: AKFSPYLGQMINLRRLLLSHIHAS (PRAME_HUMAN)
  Core: LLLSHIHAS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLRRXLLXHXHAX

SEQ ID NO: 348623 - protein, 25 aa, Artificial Sequence
  Description of Artificial Sequence: Synthetic peptide
  Seed: AKFSPYLGQMINLRRLLLSHIHASS (PRAME_HUMAN)
  Core: FSPYLGQMI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AKXSPXLXQMXNLRRLLLSHIHASS

SEQ ID NO: 348624 - protein, 25 aa, Artificial Sequence
  Description of Artificial Sequence: Synthetic peptide
  Seed: AKFSPYLGQMINLRRLLLSHIHASS (PRAME_HUMAN)
  Core: YLGQMINLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPXLGXMXNLXRLLLSHIHASS

SEQ ID NO: 348625 - protein, 25 aa, Artificial Sequence
  Description of Artificial Sequence: Synthetic peptide
  Seed: AKFSPYLGQMINLRRLLLSHIHASS (PRAME_HUMAN)
  Core: LGQMINLRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYXGQXIXLRXLLLSHIHASS

SEQ ID NO: 348626 - protein, 25 aa, Artificial Sequence
  Description of Artificial Sequence: Synthetic peptide
  Seed: AKFSPYLGQMINLRRLLLSHIHASS (PRAME_HUMAN)
  Core: MINLRRLLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQXINXRXLLXSHIHASS

SEQ ID NO: 348627 - protein, 25 aa, Artificial Sequence
  Description of Artificial Sequence: Synthetic peptide
  Seed: AKFSPYLGQMINLRRLLLSHIHASS (PRAME_HUMAN)
  Core: INLRRLLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMXNLXRXLLXHIHASS

SEQ ID NO: 348628 - protein, 25 aa, Artificial Sequence
  Description of Artificial Sequence: Synthetic peptide
  Seed: AKFSPYLGQMINLRRLLLSHIHASS (PRAME_HUMAN)
  Core: LRRLLLSHI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINXRRXLXSHXHASS

SEQ ID NO: 348629 - protein, 25 aa, Artificial Sequence
  Description of Artificial Sequence: Synthetic peptide
  Seed: AKFSPYLGQMINLRRLLLSHIHASS (PRAME_HUMAN)
  Core: RRLLLSHIH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLXRLXLXHIXASS

SEQ ID NO: 348630 - protein, 25 aa, Artificial Sequence
  Description of Artificial Sequence: Synthetic peptide
  Seed: AKFSPYLGQMINLRRLLLSHIHASS (PRAME_HUMAN)
  Core: LLLSHIHAS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AKFSPYLGQMINLRRXLLXHXHAXS

SEQ ID NO: 348631 - protein, 13 aa, Artificial Sequence
  Description of Artificial Sequence: Synthetic peptide
  Seed: ALAIAALELLPRE (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXE

SEQ ID NO: 348632 - protein, 14 aa, Artificial Sequence
  Description of Artificial Sequence: Synthetic peptide
  Seed: ALAIAALELLPREL (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXEL

SEQ ID NO: 348633 - protein, 15 aa, Artificial Sequence
  Description of Artificial Sequence: Synthetic peptide
  Seed: ALAIAALELLPRELF (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELF

SEQ ID NO: 348634 - protein, 15 aa, Artificial Sequence
  Description of Artificial Sequence: Synthetic peptide
  Seed: ALAIAALELLPRELF (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELX

SEQ ID NO: 348635 - protein, 16 aa, Artificial Sequence
  Description of Artificial Sequence: Synthetic peptide
  Seed: ALAIAALELLPRELFP (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFP

SEQ ID NO: 348636 - protein, 16 aa, Artificial Sequence
  Description of Artificial Sequence: Synthetic peptide
  Seed: ALAIAALELLPRELFP (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXP

SEQ ID NO: 348637 - protein, 17 aa, Artificial Sequence
  Description of Artificial Sequence: Synthetic peptide
  Seed: ALAIAALELLPRELFPP (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPP

SEQ ID NO: 348638 - protein, 17 aa, Artificial Sequence
  Description of Artificial Sequence: Synthetic peptide
  Seed: ALAIAALELLPRELFPP (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPP

SEQ ID NO: 348639 - protein, 17 aa, Artificial Sequence
  Description of Artificial Sequence: Synthetic peptide
  Seed: ALAIAALELLPRELFPP (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPP

SEQ ID NO: 348640 - protein, 18 aa, Artificial Sequence
  Description of Artificial Sequence: Synthetic peptide
  Seed: ALAIAALELLPRELFPPL (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPL

SEQ ID NO: 348641 - protein, 18 aa, Artificial Sequence
  Description of Artificial Sequence: Synthetic peptide
  Seed: ALAIAALELLPRELFPPL (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPL

SEQ ID NO: 348642 - protein, 19 aa, Artificial Sequence
  Description of Artificial Sequence: Synthetic peptide
  Seed: ALAIAALELLPRELFPPLF (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLF

SEQ ID NO: 348643 - protein, 19 aa, Artificial Sequence
  Description of Artificial Sequence: Synthetic peptide
  Seed: ALAIAALELLPRELFPPLF (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLF

SEQ ID NO: 348644 - protein, 19 aa, Artificial Sequence
  Description of Artificial Sequence: Synthetic peptide
  Seed: ALAIAALELLPRELFPPLF (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLF

SEQ ID NO: 348645 - protein, 20 aa, Artificial Sequence
  Description of Artificial Sequence: Synthetic peptide
  Seed: ALAIAALELLPRELFPPLFM (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFM

SEQ ID NO: 348646 - protein, 20 aa, Artificial Sequence
  Description of Artificial Sequence: Synthetic peptide
  Seed: ALAIAALELLPRELFPPLFM (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFM

SEQ ID NO: 348647 - protein, 20 aa, Artificial Sequence
  Description of Artificial Sequence: Synthetic peptide
  Seed: ALAIAALELLPRELFPPLFM (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFM

SEQ ID NO: 348648 - protein, 20 aa, Artificial Sequence
  Description of Artificial Sequence: Synthetic peptide
  Seed: ALAIAALELLPRELFPPLFM (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXM

SEQ ID NO: 348649 - protein, 20 aa, Artificial Sequence
  Description of Artificial Sequence: Synthetic peptide
  Seed: ALAIAALELLPRELFPPLFM (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFX

SEQ ID NO: 348650 - protein, 21 aa, Artificial Sequence
  Description of Artificial Sequence: Synthetic peptide
  Seed: ALAIAALELLPRELFPPLFMA (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFMA

SEQ ID NO: 348651 - protein, 21 aa, Artificial Sequence
  Description of Artificial Sequence: Synthetic peptide
  Seed: ALAIAALELLPRELFPPLFMA (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFMA

SEQ ID NO: 348652 - protein, 21 aa, Artificial Sequence
  Description of Artificial Sequence: Synthetic peptide
  Seed: ALAIAALELLPRELFPPLFMA (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFMA

SEQ ID NO: 348653 - protein, 21 aa, Artificial Sequence
  Description of Artificial Sequence: Synthetic peptide
  Seed: ALAIAALELLPRELFPPLFMA (PRAME_HUMAN)
  Core: LLPRELFPP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALEXLPXEXFPXLFMA

SEQ ID NO: 348654 - protein, 21 aa, Artificial Sequence
  Description of Artificial Sequence: Synthetic peptide
  Seed: ALAIAALELLPRELFPPLFMA (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXMA

SEQ ID NO: 348655 - protein, 21 aa, Artificial Sequence
  Description of Artificial Sequence: Synthetic peptide
  Seed: ALAIAALELLPRELFPPLFMA (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFXA

SEQ ID NO: 348656 - protein, 22 aa, Artificial Sequence
  Description of Artificial Sequence: Synthetic peptide
  Seed: ALAIAALELLPRELFPPLFMAA (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFMAA

SEQ ID NO: 348657 - protein, 22 aa, Artificial Sequence
  Description of Artificial Sequence: Synthetic peptide
  Seed: ALAIAALELLPRELFPPLFMAA (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFMAA

SEQ ID NO: 348658 - protein, 22 aa, Artificial Sequence
  Description of Artificial Sequence: Synthetic peptide
  Seed: ALAIAALELLPRELFPPLFMAA (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFMAA

SEQ ID NO: 348659 - protein, 22 aa, Artificial Sequence
  Description of Artificial Sequence: Synthetic peptide
  Seed: ALAIAALELLPRELFPPLFMAA (PRAME_HUMAN)
  Core: LLPRELFPP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALEXLPXEXFPXLFMAA

SEQ ID NO: 348660 - protein, 22 aa, Artificial Sequence
  Description of Artificial Sequence: Synthetic peptide
  Seed: ALAIAALELLPRELFPPLFMAA (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXMAA

SEQ ID NO: 348661 - protein, 22 aa, Artificial Sequence
  Description of Artificial Sequence: Synthetic peptide
  Seed: ALAIAALELLPRELFPPLFMAA (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFXAA

SEQ ID NO: 348662 - protein, 22 aa, Artificial Sequence
  Description of Artificial Sequence: Synthetic peptide
  Seed: ALAIAALELLPRELFPPLFMAA (PRAME_HUMAN)
  Core: LFPPLFMAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPREXFPXLXMAX

SEQ ID NO: 348663 - protein, 23 aa, Artificial Sequence
  Description of Artificial Sequence: Synthetic peptide
  Seed: ALAIAALELLPRELFPPLFMAAF (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFMAAF

SEQ ID NO: 348664 - protein, 23 aa, Artificial Sequence
  Description of Artificial Sequence: Synthetic peptide
  Seed: ALAIAALELLPRELFPPLFMAAF (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFMAAF

SEQ ID NO: 348665 - protein, 23 aa, Artificial Sequence
  Description of Artificial Sequence: Synthetic peptide
  Seed: ALAIAALELLPRELFPPLFMAAF (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFMAAF

SEQ ID NO: 348666 - protein, 23 aa, Artificial Sequence
  Description of Artificial Sequence: Synthetic peptide
  Seed: ALAIAALELLPRELFPPLFMAAF (PRAME_HUMAN)
  Core: LLPRELFPP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALEXLPXEXFPXLFMAAF

SEQ ID NO: 348667 - protein, 23 aa, Artificial Sequence
  Description of Artificial Sequence: Synthetic peptide
  Seed: ALAIAALELLPRELFPPLFMAAF (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXMAAF

SEQ ID NO: 348668 - protein, 23 aa, Artificial Sequence
  Description of Artificial Sequence: Synthetic peptide
  Seed: ALAIAALELLPRELFPPLFMAAF (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFXAAF

SEQ ID NO: 348669 - protein, 23 aa, Artificial Sequence
  Description of Artificial Sequence: Synthetic peptide
  Seed: ALAIAALELLPRELFPPLFMAAF (PRAME_HUMAN)
  Core: LFPPLFMAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPREXFPXLXMAXF

SEQ ID NO: 348670 - protein, 24 aa, Artificial Sequence
  Description of Artificial Sequence: Synthetic peptide
  Seed: ALAIAALELLPRELFPPLFMAAFD (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFMAAFD

SEQ ID NO: 348671 - protein, 24 aa, Artificial Sequence
  Description of Artificial Sequence: Synthetic peptide
  Seed: ALAIAALELLPRELFPPLFMAAFD (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFMAAFD

SEQ ID NO: 348672 - protein, 24 aa, Artificial Sequence
  Description of Artificial Sequence: Synthetic peptide
  Seed: ALAIAALELLPRELFPPLFMAAFD (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFMAAFD

SEQ ID NO: 348673 - protein, 24 aa, Artificial Sequence
  Description of Artificial Sequence: Synthetic peptide
  Seed: ALAIAALELLPRELFPPLFMAAFD (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXMAAFD

SEQ ID NO: 348674 - protein, 24 aa, Artificial Sequence
  Description of Artificial Sequence: Synthetic peptide
  Seed: ALAIAALELLPRELFPPLFMAAFD (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFXAAFD

SEQ ID NO: 348675 - protein, 24 aa, Artificial Sequence
  Description of Artificial Sequence: Synthetic peptide
  Seed: ALAIAALELLPRELFPPLFMAAFD (PRAME_HUMAN)
  Core: LFPPLFMAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPREXFPXLXMAXFD

SEQ ID NO: 348676 - protein, 25 aa, Artificial Sequence
  Description of Artificial Sequence: Synthetic peptide
  Seed: ALAIAALELLPRELFPPLFMAAFDG (PRAME_HUMAN)
  Core: IAALELLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALAXAAXEXLPXELFPPLFMAAFDG

SEQ ID NO: 348677 - protein, 25 aa, Artificial Sequence
  Description of Artificial Sequence: Synthetic peptide
  Seed: ALAIAALELLPRELFPPLFMAAFDG (PRAME_HUMAN)
  Core: ALELLPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAXLEXLXREXFPPLFMAAFDG

SEQ ID NO: 348678 - protein, 25 aa, Artificial Sequence
  Description of Artificial Sequence: Synthetic peptide
  Seed: ALAIAALELLPRELFPPLFMAAFDG (PRAME_HUMAN)
  Core: LELLPRELF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAAXELXPXELXPPLFMAAFDG

SEQ ID NO: 348679 - protein, 25 aa, Artificial Sequence
  Description of Artificial Sequence: Synthetic peptide
  Seed: ALAIAALELLPRELFPPLFMAAFDG (PRAME_HUMAN)
  Core: PRELFPPLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLXREXFXPLXMAAFDG

SEQ ID NO: 348680 - protein, 25 aa, Artificial Sequence
  Description of Artificial Sequence: Synthetic peptide
  Seed: ALAIAALELLPRELFPPLFMAAFDG (PRAME_HUMAN)
  Core: RELFPPLFM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPXELXPXLFXAAFDG

SEQ ID NO: 348681 - protein, 25 aa, Artificial Sequence
  Description of Artificial Sequence: Synthetic peptide
  Seed: ALAIAALELLPRELFPPLFMAAFDG (PRAME_HUMAN)
  Core: LFPPLFMAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALAIAALELLPREXFPXLXMAXFDG

SEQ ID NO: 348682 - protein, 14 aa, Artificial Sequence
  Description of Artificial Sequence: Synthetic peptide
  Seed: ALELLPRELFPPLF (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLF

SEQ ID NO: 348683 - protein, 14 aa, Artificial Sequence
  Description of Artificial Sequence: Synthetic peptide
  Seed: ALELLPRELFPPLF (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLF

SEQ ID NO: 348684 - protein, 15 aa, Artificial Sequence
  Description of Artificial Sequence: Synthetic peptide
  Seed: ALELLPRELFPPLFM (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFM

SEQ ID NO: 348685 - protein, 15 aa, Artificial Sequence
  Description of Artificial Sequence: Synthetic peptide
  Seed: ALELLPRELFPPLFM (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLFM

SEQ ID NO: 348686 - protein, 15 aa, Artificial Sequence
  Description of Artificial Sequence: Synthetic peptide
  Seed: ALELLPRELFPPLFM (PRAME_HUMAN)
  Core: LPRELFPPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALELXPRXLXPPXFM

SEQ ID NO: 348687 - protein, 15 aa, Artificial Sequence
  Description of Artificial Sequence: Synthetic peptide
  Seed: ALELLPRELFPPLFM (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXM

SEQ ID NO: 348688 - protein, 15 aa, Artificial Sequence
  Description of Artificial Sequence: Synthetic peptide
  Seed: ALELLPRELFPPLFM (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFX

SEQ ID NO: 348689 - protein, 16 aa, Artificial Sequence
  Description of Artificial Sequence: Synthetic peptide
  Seed: ALELLPRELFPPLFMA (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMA

SEQ ID NO: 348690 - protein, 16 aa, Artificial Sequence
  Description of Artificial Sequence: Synthetic peptide
  Seed: ALELLPRELFPPLFMA (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLFMA

SEQ ID NO: 348691 - protein, 16 aa, Artificial Sequence
  Description of Artificial Sequence: Synthetic peptide
  Seed: ALELLPRELFPPLFMA (PRAME_HUMAN)
  Core: LPRELFPPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALELXPRXLXPPXFMA

SEQ ID NO: 348692 - protein, 16 aa, Artificial Sequence
  Description of Artificial Sequence: Synthetic peptide
  Seed: ALELLPRELFPPLFMA (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMA

SEQ ID NO: 348693 - protein, 16 aa, Artificial Sequence
  Description of Artificial Sequence: Synthetic peptide
  Seed: ALELLPRELFPPLFMA (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXA

SEQ ID NO: 348694 - protein, 17 aa, Artificial Sequence
  Description of Artificial Sequence: Synthetic peptide
  Seed: ALELLPRELFPPLFMAA (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMAA

SEQ ID NO: 348695 - protein, 17 aa, Artificial Sequence
  Description of Artificial Sequence: Synthetic peptide
  Seed: ALELLPRELFPPLFMAA (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLFMAA

SEQ ID NO: 348696 - protein, 17 aa, Artificial Sequence
  Description of Artificial Sequence: Synthetic peptide
  Seed: ALELLPRELFPPLFMAA (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAA

SEQ ID NO: 348697 - protein, 17 aa, Artificial Sequence
  Description of Artificial Sequence: Synthetic peptide
  Seed: ALELLPRELFPPLFMAA (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAA

SEQ ID NO: 348698 - protein, 17 aa, Artificial Sequence
  Description of Artificial Sequence: Synthetic peptide
  Seed: ALELLPRELFPPLFMAA (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAX

SEQ ID NO: 348699 - protein, 18 aa, Artificial Sequence
  Description of Artificial Sequence: Synthetic peptide
  Seed: ALELLPRELFPPLFMAAF (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLFMAAF

SEQ ID NO: 348700 - protein, 18 aa, Artificial Sequence
  Description of Artificial Sequence: Synthetic peptide
  Seed: ALELLPRELFPPLFMAAF (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAF

SEQ ID NO: 348701 - protein, 18 aa, Artificial Sequence
  Description of Artificial Sequence: Synthetic peptide
  Seed: ALELLPRELFPPLFMAAF (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAF

SEQ ID NO: 348702 - protein, 18 aa, Artificial Sequence
  Description of Artificial Sequence: Synthetic peptide
  Seed: ALELLPRELFPPLFMAAF (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXF

SEQ ID NO: 348703 - protein, 19 aa, Artificial Sequence
  Description of Artificial Sequence: Synthetic peptide
  Seed: ALELLPRELFPPLFMAAFD (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMAAFD

SEQ ID NO: 348704 - protein, 19 aa, Artificial Sequence
  Description of Artificial Sequence: Synthetic peptide
  Seed: ALELLPRELFPPLFMAAFD (PRAME_HUMAN)
  Core: LLPRELFPP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALEXLPXEXFPXLFMAAFD

SEQ ID NO: 348705 - protein, 19 aa, Artificial Sequence
  Description of Artificial Sequence: Synthetic peptide
  Seed: ALELLPRELFPPLFMAAFD (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFD

SEQ ID NO: 348706 - protein, 19 aa, Artificial Sequence
  Description of Artificial Sequence: Synthetic peptide
  Seed: ALELLPRELFPPLFMAAFD (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFD

SEQ ID NO: 348707 - protein, 19 aa, Artificial Sequence
  Description of Artificial Sequence: Synthetic peptide
  Seed: ALELLPRELFPPLFMAAFD (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFD

SEQ ID NO: 348708 - protein, 20 aa, Artificial Sequence
  Description of Artificial Sequence: Synthetic peptide
  Seed: ALELLPRELFPPLFMAAFDG (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMAAFDG

SEQ ID NO: 348709 - protein, 20 aa, Artificial Sequence
  Description of Artificial Sequence: Synthetic peptide
  Seed: ALELLPRELFPPLFMAAFDG (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDG

SEQ ID NO: 348710 - protein, 20 aa, Artificial Sequence
  Description of Artificial Sequence: Synthetic peptide
  Seed: ALELLPRELFPPLFMAAFDG (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDG

SEQ ID NO: 348711 - protein, 20 aa, Artificial Sequence
  Description of Artificial Sequence: Synthetic peptide
  Seed: ALELLPRELFPPLFMAAFDG (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDG

SEQ ID NO: 348712 - protein, 20 aa, Artificial Sequence
  Description of Artificial Sequence: Synthetic peptide
  Seed: ALELLPRELFPPLFMAAFDG (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDX

SEQ ID NO: 348713 - protein, 21 aa, Artificial Sequence
  Description of Artificial Sequence: Synthetic peptide
  Seed: ALELLPRELFPPLFMAAFDGR (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMAAFDGR

SEQ ID NO: 348714 - protein, 21 aa, Artificial Sequence
  Description of Artificial Sequence: Synthetic peptide
  Seed: ALELLPRELFPPLFMAAFDGR (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDGR

SEQ ID NO: 348715 - protein, 21 aa, Artificial Sequence
  Description of Artificial Sequence: Synthetic peptide
  Seed: ALELLPRELFPPLFMAAFDGR (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDGR

SEQ ID NO: 348716 - protein, 21 aa, Artificial Sequence
  Description of Artificial Sequence: Synthetic peptide
  Seed: ALELLPRELFPPLFMAAFDGR (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDGR

SEQ ID NO: 348717 - protein, 21 aa, Artificial Sequence
  Description of Artificial Sequence: Synthetic peptide
  Seed: ALELLPRELFPPLFMAAFDGR (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDXR

SEQ ID NO: 348718 - protein, 22 aa, Artificial Sequence
  Description of Artificial Sequence: Synthetic peptide
  Seed: ALELLPRELFPPLFMAAFDGRH (PRAME_HUMAN)
  Core: LELLPRELF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXELXPXELXPPLFMAAFDGRH

SEQ ID NO: 348719 - protein, 22 aa, Artificial Sequence
  Description of Artificial Sequence: Synthetic peptide
  Seed: ALELLPRELFPPLFMAAFDGRH (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDGRH

SEQ ID NO: 348720 - protein, 22 aa, Artificial Sequence
  Description of Artificial Sequence: Synthetic peptide
  Seed: ALELLPRELFPPLFMAAFDGRH (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDGRH

SEQ ID NO: 348721 - protein, 22 aa, Artificial Sequence
  Description of Artificial Sequence: Synthetic peptide
  Seed: ALELLPRELFPPLFMAAFDGRH (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDGRH

SEQ ID NO: 348722 - protein, 22 aa, Artificial Sequence
  Description of Artificial Sequence: Synthetic peptide
  Seed: ALELLPRELFPPLFMAAFDGRH (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDXRH

SEQ ID NO: 348723 - protein, 23 aa, Artificial Sequence
  Description of Artificial Sequence: Synthetic peptide
  Seed: ALELLPRELFPPLFMAAFDGRHS (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDGRHS

SEQ ID NO: 348724 - protein, 23 aa, Artificial Sequence
  Description of Artificial Sequence: Synthetic peptide
  Seed: ALELLPRELFPPLFMAAFDGRHS (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDGRHS

SEQ ID NO: 348725 - protein, 23 aa, Artificial Sequence
  Description of Artificial Sequence: Synthetic peptide
  Seed: ALELLPRELFPPLFMAAFDGRHS (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDGRHS

SEQ ID NO: 348726 - protein, 23 aa, Artificial Sequence
  Description of Artificial Sequence: Synthetic peptide
  Seed: ALELLPRELFPPLFMAAFDGRHS (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDXRHS

SEQ ID NO: 348727 - protein, 23 aa, Artificial Sequence
  Description of Artificial Sequence: Synthetic peptide
  Seed: ALELLPRELFPPLFMAAFDGRHS (PRAME_HUMAN)
  Core: LFMAAFDGR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPXFMXAXDGXHS

SEQ ID NO: 348728 - protein, 23 aa, Artificial Sequence
  Description of Artificial Sequence: Synthetic peptide
  Seed: ALELLPRELFPPLFMAAFDGRHS (PRAME_HUMAN)
  Core: FMAAFDGRH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLXMAXFXGRXS

SEQ ID NO: 348729 - protein, 23 aa, Artificial Sequence
  Description of Artificial Sequence: Synthetic peptide
  Seed: ALELLPRELFPPLFMAAFDGRHS (PRAME_HUMAN)
  Core: MAAFDGRHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLFXAAXDXRHX

SEQ ID NO: 348730 - protein, 24 aa, Artificial Sequence
  Description of Artificial Sequence: Synthetic peptide
  Seed: ALELLPRELFPPLFMAAFDGRHSQ (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDGRHSQ

SEQ ID NO: 348731 - protein, 24 aa, Artificial Sequence
  Description of Artificial Sequence: Synthetic peptide
  Seed: ALELLPRELFPPLFMAAFDGRHSQ (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDGRHSQ

SEQ ID NO: 348732 - protein, 24 aa, Artificial Sequence
  Description of Artificial Sequence: Synthetic peptide
  Seed: ALELLPRELFPPLFMAAFDGRHSQ (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDGRHSQ

SEQ ID NO: 348733 - protein, 24 aa, Artificial Sequence
  Description of Artificial Sequence: Synthetic peptide
  Seed: ALELLPRELFPPLFMAAFDGRHSQ (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDXRHSQ

SEQ ID NO: 348734 - protein, 24 aa, Artificial Sequence
  Description of Artificial Sequence: Synthetic peptide
  Seed: ALELLPRELFPPLFMAAFDGRHSQ (PRAME_HUMAN)
  Core: LFMAAFDGR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPXFMXAXDGXHSQ

SEQ ID NO: 348735 - protein, 24 aa, Artificial Sequence
  Description of Artificial Sequence: Synthetic peptide
  Seed: ALELLPRELFPPLFMAAFDGRHSQ (PRAME_HUMAN)
  Core: FMAAFDGRH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLXMAXFXGRXSQ

SEQ ID NO: 348736 - protein, 24 aa, Artificial Sequence
  Description of Artificial Sequence: Synthetic peptide
  Seed: ALELLPRELFPPLFMAAFDGRHSQ (PRAME_HUMAN)
  Core: MAAFDGRHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLFXAAXDXRHXQ

SEQ ID NO: 348737 - protein, 25 aa, Artificial Sequence
  Description of Artificial Sequence: Synthetic peptide
  Seed: ALELLPRELFPPLFMAAFDGRHSQT (PRAME_HUMAN)
  Core: PRELFPPLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALELLXREXFXPLXMAAFDGRHSQT

SEQ ID NO: 348738 - protein, 25 aa, Artificial Sequence
  Description of Artificial Sequence: Synthetic peptide
  Seed: ALELLPRELFPPLFMAAFDGRHSQT (PRAME_HUMAN)
  Core: RELFPPLFM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPXELXPXLFXAAFDGRHSQT

SEQ ID NO: 348739 - protein, 25 aa, Artificial Sequence
  Description of Artificial Sequence: Synthetic peptide
  Seed: ALELLPRELFPPLFMAAFDGRHSQT (PRAME_HUMAN)
  Core: LFPPLFMAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPREXFPXLXMAXFDGRHSQT

SEQ ID NO: 348740 - protein, 25 aa, Artificial Sequence
  Description of Artificial Sequence: Synthetic peptide
  Seed: ALELLPRELFPPLFMAAFDGRHSQT (PRAME_HUMAN)
  Core: PLFMAAFDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPXLFXAXFDXRHSQT

SEQ ID NO: 348741 - protein, 25 aa, Artificial Sequence
  Description of Artificial Sequence: Synthetic peptide
  Seed: ALELLPRELFPPLFMAAFDGRHSQT (PRAME_HUMAN)
  Core: LFMAAFDGR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPXFMXAXDGXHSQT

SEQ ID NO: 348742 - protein, 25 aa, Artificial Sequence
  Description of Artificial Sequence: Synthetic peptide
  Seed: ALELLPRELFPPLFMAAFDGRHSQT (PRAME_HUMAN)
  Core: FMAAFDGRH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLXMAXFXGRXSQT

SEQ ID NO: 348743 - protein, 25 aa, Artificial Sequence
  Description of Artificial Sequence: Synthetic peptide
  Seed: ALELLPRELFPPLFMAAFDGRHSQT (PRAME_HUMAN)
  Core: MAAFDGRHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALELLPRELFPPLFXAAXDXRHXQT

SEQ ID NO: 348744 - protein, 13 aa, Artificial Sequence
  Description of Artificial Sequence: Synthetic peptide
  Seed: ALLERASATLQDL (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDX

SEQ ID NO: 348745 - protein, 14 aa, Artificial Sequence
  Description of Artificial Sequence: Synthetic peptide
  Seed: ALLERASATLQDLV (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLV

SEQ ID NO: 348746 - protein, 14 aa, Artificial Sequence
  Description of Artificial Sequence: Synthetic peptide
  Seed: ALLERASATLQDLV (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLV

SEQ ID NO: 348747 - protein, 14 aa, Artificial Sequence
  Description of Artificial Sequence: Synthetic peptide
  Seed: ALLERASATLQDLV (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXV

SEQ ID NO: 348748 - protein, 15 aa, Artificial Sequence
  Description of Artificial Sequence: Synthetic peptide
  Seed: ALLERASATLQDLVF (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVF

SEQ ID NO: 348749 - protein, 15 aa, Artificial Sequence
  Description of Artificial Sequence: Synthetic peptide
  Seed: ALLERASATLQDLVF (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVF

SEQ ID NO: 348750 - protein, 15 aa, Artificial Sequence
  Description of Artificial Sequence: Synthetic peptide
  Seed: ALLERASATLQDLVF (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVF

SEQ ID NO: 348751 - protein, 15 aa, Artificial Sequence
  Description of Artificial Sequence: Synthetic peptide
  Seed: ALLERASATLQDLVF (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVX

SEQ ID NO: 348752 - protein, 16 aa, Artificial Sequence
  Description of Artificial Sequence: Synthetic peptide
  Seed: ALLERASATLQDLVFD (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFD

SEQ ID NO: 348753 - protein, 16 aa, Artificial Sequence
  Description of Artificial Sequence: Synthetic peptide
  Seed: ALLERASATLQDLVFD (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFD

SEQ ID NO: 348754 - protein, 16 aa, Artificial Sequence
  Description of Artificial Sequence: Synthetic peptide
  Seed: ALLERASATLQDLVFD (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFD

SEQ ID NO: 348755 - protein, 16 aa, Artificial Sequence
  Description of Artificial Sequence: Synthetic peptide
  Seed: ALLERASATLQDLVFD (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXD

SEQ ID NO: 348756 - protein, 17 aa, Artificial Sequence
  Description of Artificial Sequence: Synthetic peptide
  Seed: ALLERASATLQDLVFDE (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDE

SEQ ID NO: 348757 - protein, 17 aa, Artificial Sequence
  Description of Artificial Sequence: Synthetic peptide
  Seed: ALLERASATLQDLVFDE (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDE

SEQ ID NO: 348758 - protein, 17 aa, Artificial Sequence
  Description of Artificial Sequence: Synthetic peptide
  Seed: ALLERASATLQDLVFDE (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDE

SEQ ID NO: 348759 - protein, 17 aa, Artificial Sequence
  Description of Artificial Sequence: Synthetic peptide
  Seed: ALLERASATLQDLVFDE (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDE

SEQ ID NO: 348760 - protein, 18 aa, Artificial Sequence
  Description of Artificial Sequence: Synthetic peptide
  Seed: ALLERASATLQDLVFDEC (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDEC

SEQ ID NO: 348761 - protein, 18 aa, Artificial Sequence
  Description of Artificial Sequence: Synthetic peptide
  Seed: ALLERASATLQDLVFDEC (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDEC

SEQ ID NO: 348762 - protein, 19 aa, Artificial Sequence
  Description of Artificial Sequence: Synthetic peptide
  Seed: ALLERASATLQDLVFDECG (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECG

SEQ ID NO: 348763 - protein, 19 aa, Artificial Sequence
  Description of Artificial Sequence: Synthetic peptide
  Seed: ALLERASATLQDLVFDECG (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDECG

SEQ ID NO: 348764 - protein, 19 aa, Artificial Sequence
  Description of Artificial Sequence: Synthetic peptide
  Seed: ALLERASATLQDLVFDECG (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECG

SEQ ID NO: 348765 - protein, 19 aa, Artificial Sequence
  Description of Artificial Sequence: Synthetic peptide
  Seed: ALLERASATLQDLVFDECG (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECG

SEQ ID NO: 348766 - protein, 19 aa, Artificial Sequence
  Description of Artificial Sequence: Synthetic peptide
  Seed: ALLERASATLQDLVFDECG (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXG

SEQ ID NO: 348767 - protein, 20 aa, Artificial Sequence
  Description of Artificial Sequence: Synthetic peptide
  Seed: ALLERASATLQDLVFDECGI (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGI

SEQ ID NO: 348768 - protein, 20 aa, Artificial Sequence
  Description of Artificial Sequence: Synthetic peptide
  Seed: ALLERASATLQDLVFDECGI (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDECGI

SEQ ID NO: 348769 - protein, 20 aa, Artificial Sequence
  Description of Artificial Sequence: Synthetic peptide
  Seed: ALLERASATLQDLVFDECGI (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGI

SEQ ID NO: 348770 - protein, 20 aa, Artificial Sequence
  Description of Artificial Sequence: Synthetic peptide
  Seed: ALLERASATLQDLVFDECGI (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGI

SEQ ID NO: 348771 - protein, 20 aa, Artificial Sequence
  Description of Artificial Sequence: Synthetic peptide
  Seed: ALLERASATLQDLVFDECGI (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGI

SEQ ID NO: 348772 - protein, 21 aa, Artificial Sequence
  Description of Artificial Sequence: Synthetic peptide
  Seed: ALLERASATLQDLVFDECGIT (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGIT

SEQ ID NO: 348773 - protein, 21 aa, Artificial Sequence
  Description of Artificial Sequence: Synthetic peptide
  Seed: ALLERASATLQDLVFDECGIT (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGIT

SEQ ID NO: 348774 - protein, 21 aa, Artificial Sequence
  Description of Artificial Sequence: Synthetic peptide
  Seed: ALLERASATLQDLVFDECGIT (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGIT

SEQ ID NO: 348775 - protein, 21 aa, Artificial Sequence
  Description of Artificial Sequence: Synthetic peptide
  Seed: ALLERASATLQDLVFDECGIT (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGIT

SEQ ID NO: 348776 - protein, 22 aa, Artificial Sequence
  Description of Artificial Sequence: Synthetic peptide
  Seed: ALLERASATLQDLVFDECGITD (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGITD

SEQ ID NO: 348777 - protein, 22 aa, Artificial Sequence
  Description of Artificial Sequence: Synthetic peptide
  Seed: ALLERASATLQDLVFDECGITD (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGITD

SEQ ID NO: 348778 - protein, 22 aa, Artificial Sequence
  Description of Artificial Sequence: Synthetic peptide
  Seed: ALLERASATLQDLVFDECGITD (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGITD

SEQ ID NO: 348779 - protein, 22 aa, Artificial Sequence
  Description of Artificial Sequence: Synthetic peptide
  Seed: ALLERASATLQDLVFDECGITD (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGITD

SEQ ID NO: 348780 - protein, 23 aa, Artificial Sequence
  Description of Artificial Sequence: Synthetic peptide
  Seed: ALLERASATLQDLVFDECGITDD (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGITDD

SEQ ID NO: 348781 - protein, 23 aa, Artificial Sequence
  Description of Artificial Sequence: Synthetic peptide
  Seed: ALLERASATLQDLVFDECGITDD (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDECGITDD

SEQ ID NO: 348782 - protein, 23 aa, Artificial Sequence
  Description of Artificial Sequence: Synthetic peptide
  Seed: ALLERASATLQDLVFDECGITDD (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGITDD

SEQ ID NO: 348783 - protein, 23 aa, Artificial Sequence
  Description of Artificial Sequence: Synthetic peptide
  Seed: ALLERASATLQDLVFDECGITDD (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGITDD

SEQ ID NO: 348784 - protein, 23 aa, Artificial Sequence
  Description of Artificial Sequence: Synthetic peptide
  Seed: ALLERASATLQDLVFDECGITDD (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGITDD

SEQ ID NO: 348785 - protein, 24 aa, Artificial Sequence
  Description of Artificial Sequence: Synthetic peptide
  Seed: ALLERASATLQDLVFDECGITDDQ (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGITDDQ

SEQ ID NO: 348786 - protein, 24 aa, Artificial Sequence
  Description of Artificial Sequence: Synthetic peptide
  Seed: ALLERASATLQDLVFDECGITDDQ (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDECGITDDQ

SEQ ID NO: 348787 - protein, 24 aa, Artificial Sequence
  Description of Artificial Sequence: Synthetic peptide
  Seed: ALLERASATLQDLVFDECGITDDQ (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGITDDQ

SEQ ID NO: 348788 - protein, 24 aa, Artificial Sequence
  Description of Artificial Sequence: Synthetic peptide
  Seed: ALLERASATLQDLVFDECGITDDQ (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGITDDQ

SEQ ID NO: 348789 - protein, 24 aa, Artificial Sequence
  Description of Artificial Sequence: Synthetic peptide
  Seed: ALLERASATLQDLVFDECGITDDQ (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGITDDQ

SEQ ID NO: 348790 - protein, 24 aa, Artificial Sequence
  Description of Artificial Sequence: Synthetic peptide
  Seed: ALLERASATLQDLVFDECGITDDQ (PRAME_HUMAN)
  Core: LVFDECGIT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATLQDXVFXEXGIXDDQ

SEQ ID NO: 348791 - protein, 25 aa, Artificial Sequence
  Description of Artificial Sequence: Synthetic peptide
  Seed: ALLERASATLQDLVFDECGITDDQL (PRAME_HUMAN)
  Core: LERASATLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXERXSXTLXDLVFDECGITDDQL

SEQ ID NO: 348792 - protein, 25 aa, Artificial Sequence
  Description of Artificial Sequence: Synthetic peptide
  Seed: ALLERASATLQDLVFDECGITDDQL (PRAME_HUMAN)
  Core: ERASATLQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXRAXAXLQXLVFDECGITDDQL

SEQ ID NO: 348793 - protein, 25 aa, Artificial Sequence
  Description of Artificial Sequence: Synthetic peptide
  Seed: ALLERASATLQDLVFDECGITDDQL (PRAME_HUMAN)
  Core: RASATLQDL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLEXASXTXQDXVFDECGITDDQL

SEQ ID NO: 348794 - protein, 25 aa, Artificial Sequence
  Description of Artificial Sequence: Synthetic peptide
  Seed: ALLERASATLQDLVFDECGITDDQL (PRAME_HUMAN)
  Core: SATLQDLVF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLERAXATXQXLVXDECGITDDQL

SEQ ID NO: 348795 - protein, 25 aa, Artificial Sequence
  Description of Artificial Sequence: Synthetic peptide
  Seed: ALLERASATLQDLVFDECGITDDQL (PRAME_HUMAN)
  Core: LQDLVFDEC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATXQDXVXDEXGITDDQL

SEQ ID NO: 348796 - protein, 25 aa, Artificial Sequence
  Description of Artificial Sequence: Synthetic peptide
  Seed: ALLERASATLQDLVFDECGITDDQL (PRAME_HUMAN)
  Core: LVFDECGIT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALLERASATLQDXVFXEXGIXDDQL

SEQ ID NO: 348797 - protein, 14 aa, Artificial Sequence
  Description of Artificial Sequence: Synthetic peptide
  Seed: ALLPSLSHCSQLTT (PRAME_HUMAN)
  Core: LLPSLSHCS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLPXLXHCXQLTT

SEQ ID NO: 348798 - protein, 14 aa, Artificial Sequence
  Description of Artificial Sequence: Synthetic peptide
  Seed: ALLPSLSHCSQLTT (PRAME_HUMAN)
  Core: PSLSHCSQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXSLXHXSQXTT

SEQ ID NO: 348799 - protein, 15 aa, Artificial Sequence
  Description of Artificial Sequence: Synthetic peptide
  Seed: ALLPSLSHCSQLTTL (PRAME_HUMAN)
  Core: LLPSLSHCS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLPXLXHCXQLTTL

SEQ ID NO: 348800 - protein, 15 aa, Artificial Sequence
  Description of Artificial Sequence: Synthetic peptide
  Seed: ALLPSLSHCSQLTTL (PRAME_HUMAN)
  Core: PSLSHCSQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXSLXHXSQXTTL

SEQ ID NO: 348801 - protein, 15 aa, Artificial Sequence
  Description of Artificial Sequence: Synthetic peptide
  Seed: ALLPSLSHCSQLTTL (PRAME_HUMAN)
  Core: SLSHCSQLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLPXLSXCXQLXTL

SEQ ID NO: 348802 - protein, 15 aa, Artificial Sequence
  Description of Artificial Sequence: Synthetic peptide
  Seed: ALLPSLSHCSQLTTL (PRAME_HUMAN)
  Core: LSHCSQLTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSXSHXSXLTXL

SEQ ID NO: 348803 - protein, 16 aa, Artificial Sequence
  Description of Artificial Sequence: Synthetic peptide
  Seed: ALLPSLSHCSQLTTLS (PRAME_HUMAN)
  Core: LLPSLSHCS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLPXLXHCXQLTTLS

SEQ ID NO: 348804 - protein, 16 aa, Artificial Sequence
  Description of Artificial Sequence: Synthetic peptide
  Seed: ALLPSLSHCSQLTTLS (PRAME_HUMAN)
  Core: PSLSHCSQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALLXSLXHXSQXTTLS

SEQ ID NO: 348805 - protein, 16 aa, Artificial Sequence
  Description of Artificial Sequence: Synthetic peptide
  Seed: ALLPSLSHCSQLTTLS (PRAME_HUMAN)
  Core: LSHCSQLTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSXSHXSXLTXLS

SEQ ID NO: 348806 - protein, 16 aa, Artificial Sequence
  Description of Artificial Sequence: Synthetic peptide
  Seed: ALLPSLSHCSQLTTLS (PRAME_HUMAN)
  Core: SHCSQLTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLXHCXQXTTXS

SEQ ID NO: 348807 - protein, 17 aa, Artificial Sequence
  Description of Artificial Sequence: Synthetic peptide
  Seed: ALLPSLSHCSQLTTLSF (PRAME_HUMAN)
  Core: LLPSLSHCS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLPXLXHCXQLTTLSF

SEQ ID NO: 348808 - protein, 17 aa, Artificial Sequence
  Description of Artificial Sequence: Synthetic peptide
  Seed: ALLPSLSHCSQLTTLSF (PRAME_HUMAN)
  Core: LSHCSQLTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSXSHXSXLTXLSF

SEQ ID NO: 348809 - protein, 17 aa, Artificial Sequence
  Description of Artificial Sequence: Synthetic peptide
  Seed: ALLPSLSHCSQLTTLSF (PRAME_HUMAN)
  Core: SHCSQLTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLXHCXQXTTXSF

SEQ ID NO: 348810 - protein, 19 aa, Artificial Sequence
  Description of Artificial Sequence: Synthetic peptide
  Seed: ALLPSLSHCSQLTTLSFYG (PRAME_HUMAN)
  Core: LSHCSQLTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSXSHXSXLTXLSFYG

SEQ ID NO: 348811 - protein, 19 aa, Artificial Sequence
  Description of Artificial Sequence: Synthetic peptide
  Seed: ALLPSLSHCSQLTTLSFYG (PRAME_HUMAN)
  Core: SHCSQLTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLXHCXQXTTXSFYG

SEQ ID NO: 348812 - protein, 19 aa, Artificial Sequence
  Description of Artificial Sequence: Synthetic peptide
  Seed: ALLPSLSHCSQLTTLSFYG (PRAME_HUMAN)
  Core: CSQLTTLSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHXSQXTXLSXYG

SEQ ID NO: 348813 - protein, 20 aa, Artificial Sequence
  Description of Artificial Sequence: Synthetic peptide
  Seed: ALLPSLSHCSQLTTLSFYGN (PRAME_HUMAN)
  Core: SLSHCSQLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLPXLSXCXQLXTLSFYGN

SEQ ID NO: 348814 - protein, 20 aa, Artificial Sequence
  Description of Artificial Sequence: Synthetic peptide
  Seed: ALLPSLSHCSQLTTLSFYGN (PRAME_HUMAN)
  Core: LSHCSQLTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSXSHXSXLTXLSFYGN

SEQ ID NO: 348815 - protein, 20 aa, Artificial Sequence
  Description of Artificial Sequence: Synthetic peptide
  Seed: ALLPSLSHCSQLTTLSFYGN (PRAME_HUMAN)
  Core: SHCSQLTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLXHCXQXTTXSFYGN

SEQ ID NO: 348816 - protein, 20 aa, Artificial Sequence
  Description of Artificial Sequence: Synthetic peptide
  Seed: ALLPSLSHCSQLTTLSFYGN (PRAME_HUMAN)
  Core: CSQLTTLSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHXSQXTXLSXYGN

SEQ ID NO: 348817 - protein, 20 aa, Artificial Sequence
  Description of Artificial Sequence: Synthetic peptide
  Seed: ALLPSLSHCSQLTTLSFYGN (PRAME_HUMAN)
  Core: QLTTLSFYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSXLTXLXFYXN

SEQ ID NO: 348818 - protein, 20 aa, Artificial Sequence
  Description of Artificial Sequence: Synthetic peptide
  Seed: ALLPSLSHCSQLTTLSFYGN (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGX

SEQ ID NO: 348819 - protein, 21 aa, Artificial Sequence
  Description of Artificial Sequence: Synthetic peptide
  Seed: ALLPSLSHCSQLTTLSFYGNS (PRAME_HUMAN)
  Core: CSQLTTLSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHXSQXTXLSXYGNS

SEQ ID NO: 348820 - protein, 21 aa, Artificial Sequence
  Description of Artificial Sequence: Synthetic peptide
  Seed: ALLPSLSHCSQLTTLSFYGNS (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGXS

SEQ ID NO: 348821 - protein, 22 aa, Artificial Sequence
  Description of Artificial Sequence: Synthetic peptide
  Seed: ALLPSLSHCSQLTTLSFYGNSI (PRAME_HUMAN)
  Core: CSQLTTLSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHXSQXTXLSXYGNSI

SEQ ID NO: 348822 - protein, 22 aa, Artificial Sequence
  Description of Artificial Sequence: Synthetic peptide
  Seed: ALLPSLSHCSQLTTLSFYGNSI (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGXSI

SEQ ID NO: 348823 - protein, 22 aa, Artificial Sequence
  Description of Artificial Sequence: Synthetic peptide
  Seed: ALLPSLSHCSQLTTLSFYGNSI (PRAME_HUMAN)
  Core: TLSFYGNSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTXLSXYXNSX

SEQ ID NO: 348824 - protein, 23 aa, Artificial Sequence
  Description of Artificial Sequence: Synthetic peptide
  Seed: ALLPSLSHCSQLTTLSFYGNSIS (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGXSIS

SEQ ID NO: 348825 - protein, 23 aa, Artificial Sequence
  Description of Artificial Sequence: Synthetic peptide
  Seed: ALLPSLSHCSQLTTLSFYGNSIS (PRAME_HUMAN)
  Core: TLSFYGNSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTXLSXYXNSXS

SEQ ID NO: 348826 - protein, 23 aa, Artificial Sequence
  Description of Artificial Sequence: Synthetic peptide
  Seed: ALLPSLSHCSQLTTLSFYGNSIS (PRAME_HUMAN)
  Core: LSFYGNSIS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTTXSFXGXSIX

SEQ ID NO: 348827 - protein, 24 aa, Artificial Sequence
  Description of Artificial Sequence: Synthetic peptide
  Seed: ALLPSLSHCSQLTTLSFYGNSISI (PRAME_HUMAN)
  Core: QLTTLSFYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSXLTXLXFYXNSISI

SEQ ID NO: 348828 - protein, 24 aa, Artificial Sequence
  Description of Artificial Sequence: Synthetic peptide
  Seed: ALLPSLSHCSQLTTLSFYGNSISI (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGXSISI

SEQ ID NO: 348829 - protein, 24 aa, Artificial Sequence
  Description of Artificial Sequence: Synthetic peptide
  Seed: ALLPSLSHCSQLTTLSFYGNSISI (PRAME_HUMAN)
  Core: TLSFYGNSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTXLSXYXNSXSI

SEQ ID NO: 348830 - protein, 24 aa, Artificial Sequence
  Description of Artificial Sequence: Synthetic peptide
  Seed: ALLPSLSHCSQLTTLSFYGNSISI (PRAME_HUMAN)
  Core: LSFYGNSIS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTTXSFXGXSIXI

SEQ ID NO: 348831 - protein, 25 aa, Artificial Sequence
  Description of Artificial Sequence: Synthetic peptide
  Seed: ALLPSLSHCSQLTTLSFYGNSISIS (PRAME_HUMAN)
  Core: QLTTLSFYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSXLTXLXFYXNSISIS

SEQ ID NO: 348832 - protein, 25 aa, Artificial Sequence
  Description of Artificial Sequence: Synthetic peptide
  Seed: ALLPSLSHCSQLTTLSFYGNSISIS (PRAME_HUMAN)
  Core: LTTLSFYGN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQXTTXSXYGXSISIS

SEQ ID NO: 348833 - protein, 25 aa, Artificial Sequence
  Description of Artificial Sequence: Synthetic peptide
  Seed: ALLPSLSHCSQLTTLSFYGNSISIS (PRAME_HUMAN)
  Core: TLSFYGNSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTXLSXYXNSXSIS

SEQ ID NO: 348834 - protein, 25 aa, Artificial Sequence
  Description of Artificial Sequence: Synthetic peptide
  Seed: ALLPSLSHCSQLTTLSFYGNSISIS (PRAME_HUMAN)
  Core: LSFYGNSIS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTTXSFXGXSIXIS

SEQ ID NO: 348835 - protein, 25 aa, Artificial Sequence
  Description of Artificial Sequence: Synthetic peptide
  Seed: ALLPSLSHCSQLTTLSFYGNSISIS (PRAME_HUMAN)
  Core: FYGNSISIS
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
ALLPSLSHCSQLTTLSXYGXSXSIX

SEQ ID NO: 348836 - protein, 13 aa, Artificial Sequence
  Description of Artificial Sequence: Synthetic peptide
  Seed: ALQSLLQHLIGLS (PRAME_HUMAN)
  Core: LQSLLQHLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXQSXLXHLXGLS

SEQ ID NO: 348837 - protein, 13 aa, Artificial Sequence
  Description of Artificial Sequence: Synthetic peptide
  Seed: ALQSLLQHLIGLS (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLX

SEQ ID NO: 348838 - protein, 14 aa, Artificial Sequence
  Description of Artificial Sequence: Synthetic peptide
  Seed: ALQSLLQHLIGLSN (PRAME_HUMAN)
  Core: LQSLLQHLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXQSXLXHLXGLSN

SEQ ID NO: 348839 - protein, 14 aa, Artificial Sequence
  Description of Artificial Sequence: Synthetic peptide
  Seed: ALQSLLQHLIGLSN (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXN

SEQ ID NO: 348840 - protein, 14 aa, Artificial Sequence
  Description of Artificial Sequence: Synthetic peptide
  Seed: ALQSLLQHLIGLSN (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSX

SEQ ID NO: 348841 - protein, 15 aa, Artificial Sequence
  Description of Artificial Sequence: Synthetic peptide
  Seed: ALQSLLQHLIGLSNL (PRAME_HUMAN)
  Core: LQSLLQHLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXQSXLXHLXGLSNL

SEQ ID NO: 348842 - protein, 15 aa, Artificial Sequence
  Description of Artificial Sequence: Synthetic peptide
  Seed: ALQSLLQHLIGLSNL (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNL

SEQ ID NO: 348843 - protein, 15 aa, Artificial Sequence
  Description of Artificial Sequence: Synthetic peptide
  Seed: ALQSLLQHLIGLSNL (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXL

SEQ ID NO: 348844 - protein, 16 aa, Artificial Sequence
  Description of Artificial Sequence: Synthetic peptide
  Seed: ALQSLLQHLIGLSNLT (PRAME_HUMAN)
  Core: LQSLLQHLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXQSXLXHLXGLSNLT

SEQ ID NO: 348845 - protein, 16 aa, Artificial Sequence
  Description of Artificial Sequence: Synthetic peptide
  Seed: ALQSLLQHLIGLSNLT (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLT

SEQ ID NO: 348846 - protein, 16 aa, Artificial Sequence
  Description of Artificial Sequence: Synthetic peptide
  Seed: ALQSLLQHLIGLSNLT (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLT

SEQ ID NO: 348847 - protein, 17 aa, Artificial Sequence
  Description of Artificial Sequence: Synthetic peptide
  Seed: ALQSLLQHLIGLSNLTH (PRAME_HUMAN)
  Core: LQSLLQHLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXQSXLXHLXGLSNLTH

SEQ ID NO: 348848 - protein, 17 aa, Artificial Sequence
  Description of Artificial Sequence: Synthetic peptide
  Seed: ALQSLLQHLIGLSNLTH (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTH

SEQ ID NO: 348849 - protein, 17 aa, Artificial Sequence
  Description of Artificial Sequence: Synthetic peptide
  Seed: ALQSLLQHLIGLSNLTH (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTH

SEQ ID NO: 348850 - protein, 17 aa, Artificial Sequence
  Description of Artificial Sequence: Synthetic peptide
  Seed: ALQSLLQHLIGLSNLTH (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTX

SEQ ID NO: 348851 - protein, 18 aa, Artificial Sequence
  Description of Artificial Sequence: Synthetic peptide
  Seed: ALQSLLQHLIGLSNLTHV (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHV

SEQ ID NO: 348852 - protein, 18 aa, Artificial Sequence
  Description of Artificial Sequence: Synthetic peptide
  Seed: ALQSLLQHLIGLSNLTHV (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHV

SEQ ID NO: 348853 - protein, 18 aa, Artificial Sequence
  Description of Artificial Sequence: Synthetic peptide
  Seed: ALQSLLQHLIGLSNLTHV (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXV

SEQ ID NO: 348854 - protein, 19 aa, Artificial Sequence
  Description of Artificial Sequence: Synthetic peptide
  Seed: ALQSLLQHLIGLSNLTHVL (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVL

SEQ ID NO: 348855 - protein, 19 aa, Artificial Sequence
  Description of Artificial Sequence: Synthetic peptide
  Seed: ALQSLLQHLIGLSNLTHVL (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVL

SEQ ID NO: 348856 - protein, 19 aa, Artificial Sequence
  Description of Artificial Sequence: Synthetic peptide
  Seed: ALQSLLQHLIGLSNLTHVL (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVL

SEQ ID NO: 348857 - protein, 19 aa, Artificial Sequence
  Description of Artificial Sequence: Synthetic peptide
  Seed: ALQSLLQHLIGLSNLTHVL (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXL

SEQ ID NO: 348858 - protein, 20 aa, Artificial Sequence
  Description of Artificial Sequence: Synthetic peptide
  Seed: ALQSLLQHLIGLSNLTHVLY (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLY

SEQ ID NO: 348859 - protein, 20 aa, Artificial Sequence
  Description of Artificial Sequence: Synthetic peptide
  Seed: ALQSLLQHLIGLSNLTHVLY (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLY

SEQ ID NO: 348860 - protein, 20 aa, Artificial Sequence
  Description of Artificial Sequence: Synthetic peptide
  Seed: ALQSLLQHLIGLSNLTHVLY (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLY

SEQ ID NO: 348861 - protein, 20 aa, Artificial Sequence
  Description of Artificial Sequence: Synthetic peptide
  Seed: ALQSLLQHLIGLSNLTHVLY (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLY

SEQ ID NO: 348862 - protein, 21 aa, Artificial Sequence
  Description of Artificial Sequence: Synthetic peptide
  Seed: ALQSLLQHLIGLSNLTHVLYP (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLYP

SEQ ID NO: 348863 - protein, 21 aa, Artificial Sequence
  Description of Artificial Sequence: Synthetic peptide
  Seed: ALQSLLQHLIGLSNLTHVLYP (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLYP

SEQ ID NO: 348864 - protein, 21 aa, Artificial Sequence
  Description of Artificial Sequence: Synthetic peptide
  Seed: ALQSLLQHLIGLSNLTHVLYP (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLYP

SEQ ID NO: 348865 - protein, 21 aa, Artificial Sequence
  Description of Artificial Sequence: Synthetic peptide
  Seed: ALQSLLQHLIGLSNLTHVLYP (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLYP

SEQ ID NO: 348866 - protein, 21 aa, Artificial Sequence
  Description of Artificial Sequence: Synthetic peptide
  Seed: ALQSLLQHLIGLSNLTHVLYP (PRAME_HUMAN)
  Core: LSNLTHVLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGXSNXTXVLXP

SEQ ID NO: 348867 - protein, 22 aa, Artificial Sequence
  Description of Artificial Sequence: Synthetic peptide
  Seed: ALQSLLQHLIGLSNLTHVLYPV (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLYPV

SEQ ID NO: 348868 - protein, 22 aa, Artificial Sequence
  Description of Artificial Sequence: Synthetic peptide
  Seed: ALQSLLQHLIGLSNLTHVLYPV (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLYPV

SEQ ID NO: 348869 - protein, 22 aa, Artificial Sequence
  Description of Artificial Sequence: Synthetic peptide
  Seed: ALQSLLQHLIGLSNLTHVLYPV (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLYPV

SEQ ID NO: 348870 - protein, 22 aa, Artificial Sequence
  Description of Artificial Sequence: Synthetic peptide
  Seed: ALQSLLQHLIGLSNLTHVLYPV (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLYPV

SEQ ID NO: 348871 - protein, 22 aa, Artificial Sequence
  Description of Artificial Sequence: Synthetic peptide
  Seed: ALQSLLQHLIGLSNLTHVLYPV (PRAME_HUMAN)
  Core: LSNLTHVLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGXSNXTXVLXPV

SEQ ID NO: 348872 - protein, 23 aa, Artificial Sequence
  Description of Artificial Sequence: Synthetic peptide
  Seed: ALQSLLQHLIGLSNLTHVLYPVP (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLYPVP

SEQ ID NO: 348873 - protein, 23 aa, Artificial Sequence
  Description of Artificial Sequence: Synthetic peptide
  Seed: ALQSLLQHLIGLSNLTHVLYPVP (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLYPVP

SEQ ID NO: 348874 - protein, 23 aa, Artificial Sequence
  Description of Artificial Sequence: Synthetic peptide
  Seed: ALQSLLQHLIGLSNLTHVLYPVP (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLYPVP

SEQ ID NO: 348875 - protein, 23 aa, Artificial Sequence
  Description of Artificial Sequence: Synthetic peptide
  Seed: ALQSLLQHLIGLSNLTHVLYPVP (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLYPVP

SEQ ID NO: 348876 - protein, 23 aa, Artificial Sequence
  Description of Artificial Sequence: Synthetic peptide
  Seed: ALQSLLQHLIGLSNLTHVLYPVP (PRAME_HUMAN)
  Core: LSNLTHVLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGXSNXTXVLXPVP

SEQ ID NO: 348877 - protein, 23 aa, Artificial Sequence
  Description of Artificial Sequence: Synthetic peptide
  Seed: ALQSLLQHLIGLSNLTHVLYPVP (PRAME_HUMAN)
  Core: NLTHVLYPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGLSXLTXVXYPXP

SEQ ID NO: 348878 - protein, 24 aa, Artificial Sequence
  Description of Artificial Sequence: Synthetic peptide
  Seed: ALQSLLQHLIGLSNLTHVLYPVPL (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLYPVPL

SEQ ID NO: 348879 - protein, 24 aa, Artificial Sequence
  Description of Artificial Sequence: Synthetic peptide
  Seed: ALQSLLQHLIGLSNLTHVLYPVPL (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLYPVPL

SEQ ID NO: 348880 - protein, 24 aa, Artificial Sequence
  Description of Artificial Sequence: Synthetic peptide
  Seed: ALQSLLQHLIGLSNLTHVLYPVPL (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLYPVPL

SEQ ID NO: 348881 - protein, 24 aa, Artificial Sequence
  Description of Artificial Sequence: Synthetic peptide
  Seed: ALQSLLQHLIGLSNLTHVLYPVPL (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLYPVPL

SEQ ID NO: 348882 - protein, 24 aa, Artificial Sequence
  Description of Artificial Sequence: Synthetic peptide
  Seed: ALQSLLQHLIGLSNLTHVLYPVPL (PRAME_HUMAN)
  Core: LSNLTHVLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGXSNXTXVLXPVPL

SEQ ID NO: 348883 - protein, 24 aa, Artificial Sequence
  Description of Artificial Sequence: Synthetic peptide
  Seed: ALQSLLQHLIGLSNLTHVLYPVPL (PRAME_HUMAN)
  Core: NLTHVLYPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGLSXLTXVXYPXPL

SEQ ID NO: 348884 - protein, 25 aa, Artificial Sequence
  Description of Artificial Sequence: Synthetic peptide
  Seed: ALQSLLQHLIGLSNLTHVLYPVPLE (PRAME_HUMAN)
  Core: LLQHLIGLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALQSXLQXLXGLXNLTHVLYPVPLE

SEQ ID NO: 348885 - protein, 25 aa, Artificial Sequence
  Description of Artificial Sequence: Synthetic peptide
  Seed: ALQSLLQHLIGLSNLTHVLYPVPLE (PRAME_HUMAN)
  Core: LQHLIGLSN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLXQHXIXLSXLTHVLYPVPLE

SEQ ID NO: 348886 - protein, 25 aa, Artificial Sequence
  Description of Artificial Sequence: Synthetic peptide
  Seed: ALQSLLQHLIGLSNLTHVLYPVPLE (PRAME_HUMAN)
  Core: LIGLSNLTH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHXIGXSXLTXVLYPVPLE

SEQ ID NO: 348887 - protein, 25 aa, Artificial Sequence
  Description of Artificial Sequence: Synthetic peptide
  Seed: ALQSLLQHLIGLSNLTHVLYPVPLE (PRAME_HUMAN)
  Core: IGLSNLTHV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLXGLXNXTHXLYPVPLE

SEQ ID NO: 348888 - protein, 25 aa, Artificial Sequence
  Description of Artificial Sequence: Synthetic peptide
  Seed: ALQSLLQHLIGLSNLTHVLYPVPLE (PRAME_HUMAN)
  Core: LSNLTHVLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGXSNXTXVLXPVPLE

SEQ ID NO: 348889 - protein, 25 aa, Artificial Sequence
  Description of Artificial Sequence: Synthetic peptide
  Seed: ALQSLLQHLIGLSNLTHVLYPVPLE (PRAME_HUMAN)
  Core: NLTHVLYPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALQSLLQHLIGLSXLTXVXYPXPLE

SEQ ID NO: 348890 - protein, 13 aa, Artificial Sequence
  Description of Artificial Sequence: Synthetic peptide
  Seed: ALYVDSLFFLRGR (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGR

SEQ ID NO: 348891 - protein, 13 aa, Artificial Sequence
  Description of Artificial Sequence: Synthetic peptide
  Seed: ALYVDSLFFLRGR (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXR

SEQ ID NO: 348892 - protein, 14 aa, Artificial Sequence
  Description of Artificial Sequence: Synthetic peptide
  Seed: ALYVDSLFFLRGRL (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRL

SEQ ID NO: 348893 - protein, 14 aa, Artificial Sequence
  Description of Artificial Sequence: Synthetic peptide
  Seed: ALYVDSLFFLRGRL (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRL

SEQ ID NO: 348894 - protein, 15 aa, Artificial Sequence
  Description of Artificial Sequence: Synthetic peptide
  Seed: ALYVDSLFFLRGRLD (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLD

SEQ ID NO: 348895 - protein, 15 aa, Artificial Sequence
  Description of Artificial Sequence: Synthetic peptide
  Seed: ALYVDSLFFLRGRLD (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLD

SEQ ID NO: 348896 - protein, 15 aa, Artificial Sequence
  Description of Artificial Sequence: Synthetic peptide
  Seed: ALYVDSLFFLRGRLD (PRAME_HUMAN)
  Core: SLFFLRGRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDXLFXLXGRXD

SEQ ID NO: 348897 - protein, 15 aa, Artificial Sequence
  Description of Artificial Sequence: Synthetic peptide
  Seed: ALYVDSLFFLRGRLD (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLX

SEQ ID NO: 348898 - protein, 16 aa, Artificial Sequence
  Description of Artificial Sequence: Synthetic peptide
  Seed: ALYVDSLFFLRGRLDQ (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQ

SEQ ID NO: 348899 - protein, 16 aa, Artificial Sequence
  Description of Artificial Sequence: Synthetic peptide
  Seed: ALYVDSLFFLRGRLDQ (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLDQ

SEQ ID NO: 348900 - protein, 16 aa, Artificial Sequence
  Description of Artificial Sequence: Synthetic peptide
  Seed: ALYVDSLFFLRGRLDQ (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQ

SEQ ID NO: 348901 - protein, 17 aa, Artificial Sequence
  Description of Artificial Sequence: Synthetic peptide
  Seed: ALYVDSLFFLRGRLDQL (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQL

SEQ ID NO: 348902 - protein, 17 aa, Artificial Sequence
  Description of Artificial Sequence: Synthetic peptide
  Seed: ALYVDSLFFLRGRLDQL (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLDQL

SEQ ID NO: 348903 - protein, 17 aa, Artificial Sequence
  Description of Artificial Sequence: Synthetic peptide
  Seed: ALYVDSLFFLRGRLDQL (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQL

SEQ ID NO: 348904 - protein, 17 aa, Artificial Sequence
  Description of Artificial Sequence: Synthetic peptide
  Seed: ALYVDSLFFLRGRLDQL (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXL

SEQ ID NO: 348905 - protein, 18 aa, Artificial Sequence
  Description of Artificial Sequence: Synthetic peptide
  Seed: ALYVDSLFFLRGRLDQLL (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLL

SEQ ID NO: 348906 - protein, 18 aa, Artificial Sequence
  Description of Artificial Sequence: Synthetic peptide
  Seed: ALYVDSLFFLRGRLDQLL (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLDQLL

SEQ ID NO: 348907 - protein, 18 aa, Artificial Sequence
  Description of Artificial Sequence: Synthetic peptide
  Seed: ALYVDSLFFLRGRLDQLL (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLL

SEQ ID NO: 348908 - protein, 19 aa, Artificial Sequence
  Description of Artificial Sequence: Synthetic peptide
  Seed: ALYVDSLFFLRGRLDQLLR (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLLR

SEQ ID NO: 348909 - protein, 19 aa, Artificial Sequence
  Description of Artificial Sequence: Synthetic peptide
  Seed: ALYVDSLFFLRGRLDQLLR (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLDQLLR

SEQ ID NO: 348910 - protein, 19 aa, Artificial Sequence
  Description of Artificial Sequence: Synthetic peptide
  Seed: ALYVDSLFFLRGRLDQLLR (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLR

SEQ ID NO: 348911 - protein, 19 aa, Artificial Sequence
  Description of Artificial Sequence: Synthetic peptide
  Seed: ALYVDSLFFLRGRLDQLLR (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXLLR

SEQ ID NO: 348912 - protein, 19 aa, Artificial Sequence
  Description of Artificial Sequence: Synthetic peptide
  Seed: ALYVDSLFFLRGRLDQLLR (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLR

SEQ ID NO: 348913 - protein, 19 aa, Artificial Sequence
  Description of Artificial Sequence: Synthetic peptide
  Seed: ALYVDSLFFLRGRLDQLLR (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXR

SEQ ID NO: 348914 - protein, 20 aa, Artificial Sequence
  Description of Artificial Sequence: Synthetic peptide
  Seed: ALYVDSLFFLRGRLDQLLRH (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLLRH

SEQ ID NO: 348915 - protein, 20 aa, Artificial Sequence
  Description of Artificial Sequence: Synthetic peptide
  Seed: ALYVDSLFFLRGRLDQLLRH (PRAME_HUMAN)
  Core: VDSLFFLRG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ALYXDSXFXLRXRLDQLLRH

SEQ ID NO: 348916 - protein, 20 aa, Artificial Sequence
  Description of Artificial Sequence: Synthetic peptide
  Seed: ALYVDSLFFLRGRLDQLLRH (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRH

SEQ ID NO: 348917 - protein, 20 aa, Artificial Sequence
  Description of Artificial Sequence: Synthetic peptide
  Seed: ALYVDSLFFLRGRLDQLLRH (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXLLRH

SEQ ID NO: 348918 - protein, 20 aa, Artificial Sequence
  Description of Artificial Sequence: Synthetic peptide
  Seed: ALYVDSLFFLRGRLDQLLRH (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRH

SEQ ID NO: 348919 - protein, 20 aa, Artificial Sequence
  Description of Artificial Sequence: Synthetic peptide
  Seed: ALYVDSLFFLRGRLDQLLRH (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRH

SEQ ID NO: 348920 - protein, 21 aa, Artificial Sequence
  Description of Artificial Sequence: Synthetic peptide
  Seed: ALYVDSLFFLRGRLDQLLRHV (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLLRHV

SEQ ID NO: 348921 - protein, 21 aa, Artificial Sequence
  Description of Artificial Sequence: Synthetic peptide
  Seed: ALYVDSLFFLRGRLDQLLRHV (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRHV

SEQ ID NO: 348922 - protein, 21 aa, Artificial Sequence
  Description of Artificial Sequence: Synthetic peptide
  Seed: ALYVDSLFFLRGRLDQLLRHV (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXLLRHV

SEQ ID NO: 348923 - protein, 21 aa, Artificial Sequence
  Description of Artificial Sequence: Synthetic peptide
  Seed: ALYVDSLFFLRGRLDQLLRHV (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRHV

SEQ ID NO: 348924 - protein, 21 aa, Artificial Sequence
  Description of Artificial Sequence: Synthetic peptide
  Seed: ALYVDSLFFLRGRLDQLLRHV (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRHV

SEQ ID NO: 348925 - protein, 21 aa, Artificial Sequence
  Description of Artificial Sequence: Synthetic peptide
  Seed: ALYVDSLFFLRGRLDQLLRHV (PRAME_HUMAN)
  Core: RLDQLLRHV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGXLDXLXRHX

SEQ ID NO: 348926 - protein, 22 aa, Artificial Sequence
  Description of Artificial Sequence: Synthetic peptide
  Seed: ALYVDSLFFLRGRLDQLLRHVM (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLLRHVM

SEQ ID NO: 348927 - protein, 22 aa, Artificial Sequence
  Description of Artificial Sequence: Synthetic peptide
  Seed: ALYVDSLFFLRGRLDQLLRHVM (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRHVM

SEQ ID NO: 348928 - protein, 22 aa, Artificial Sequence
  Description of Artificial Sequence: Synthetic peptide
  Seed: ALYVDSLFFLRGRLDQLLRHVM (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXLLRHVM

SEQ ID NO: 348929 - protein, 22 aa, Artificial Sequence
  Description of Artificial Sequence: Synthetic peptide
  Seed: ALYVDSLFFLRGRLDQLLRHVM (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRHVM

SEQ ID NO: 348930 - protein, 22 aa, Artificial Sequence
  Description of Artificial Sequence: Synthetic peptide
  Seed: ALYVDSLFFLRGRLDQLLRHVM (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRHVM

SEQ ID NO: 348931 - protein, 22 aa, Artificial Sequence
  Description of Artificial Sequence: Synthetic peptide
  Seed: ALYVDSLFFLRGRLDQLLRHVM (PRAME_HUMAN)
  Core: RLDQLLRHV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGXLDXLXRHXM

SEQ ID NO: 348932 - protein, 23 aa, Artificial Sequence
  Description of Artificial Sequence: Synthetic peptide
  Seed: ALYVDSLFFLRGRLDQLLRHVMN (PRAME_HUMAN)
  Core: YVDSLFFLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXVDXLXFLXGRLDQLLRHVMN

SEQ ID NO: 348933 - protein, 23 aa, Artificial Sequence
  Description of Artificial Sequence: Synthetic peptide
  Seed: ALYVDSLFFLRGRLDQLLRHVMN (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRHVMN

SEQ ID NO: 348934 - protein, 23 aa, Artificial Sequence
  Description of Artificial Sequence: Synthetic peptide
  Seed: ALYVDSLFFLRGRLDQLLRHVMN (PRAME_HUMAN)
  Core: FFLRGRLDQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLXFLXGXLDXLLRHVMN

SEQ ID NO: 348935 - protein, 23 aa, Artificial Sequence
  Description of Artificial Sequence: Synthetic peptide
  Seed: ALYVDSLFFLRGRLDQLLRHVMN (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRHVMN

SEQ ID NO: 348936 - protein, 23 aa, Artificial Sequence
  Description of Artificial Sequence: Synthetic peptide
  Seed: ALYVDSLFFLRGRLDQLLRHVMN (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRHVMN

SEQ ID NO: 348937 - protein, 23 aa, Artificial Sequence
  Description of Artificial Sequence: Synthetic peptide
  Seed: ALYVDSLFFLRGRLDQLLRHVMN (PRAME_HUMAN)
  Core: RLDQLLRHV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGXLDXLXRHXMN

SEQ ID NO: 348938 - protein, 23 aa, Artificial Sequence
  Description of Artificial Sequence: Synthetic peptide
  Seed: ALYVDSLFFLRGRLDQLLRHVMN (PRAME_HUMAN)
  Core: LDQLLRHVM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGRXDQXLXHVXN

SEQ ID NO: 348939 - protein, 24 aa, Artificial Sequence
  Description of Artificial Sequence: Synthetic peptide
  Seed: ALYVDSLFFLRGRLDQLLRHVMNP (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRHVMNP

SEQ ID NO: 348940 - protein, 24 aa, Artificial Sequence
  Description of Artificial Sequence: Synthetic peptide
  Seed: ALYVDSLFFLRGRLDQLLRHVMNP (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRHVMNP

SEQ ID NO: 348941 - protein, 24 aa, Artificial Sequence
  Description of Artificial Sequence: Synthetic peptide
  Seed: ALYVDSLFFLRGRLDQLLRHVMNP (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRHVMNP

SEQ ID NO: 348942 - protein, 24 aa, Artificial Sequence
  Description of Artificial Sequence: Synthetic peptide
  Seed: ALYVDSLFFLRGRLDQLLRHVMNP (PRAME_HUMAN)
  Core: RLDQLLRHV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGXLDXLXRHXMNP

SEQ ID NO: 348943 - protein, 24 aa, Artificial Sequence
  Description of Artificial Sequence: Synthetic peptide
  Seed: ALYVDSLFFLRGRLDQLLRHVMNP (PRAME_HUMAN)
  Core: LDQLLRHVM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGRXDQXLXHVXNP

SEQ ID NO: 348944 - protein, 25 aa, Artificial Sequence
  Description of Artificial Sequence: Synthetic peptide
  Seed: ALYVDSLFFLRGRLDQLLRHVMNPL (PRAME_HUMAN)
  Core: LFFLRGRLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSXFFXRXRLXQLLRHVMNPL

SEQ ID NO: 348945 - protein, 25 aa, Artificial Sequence
  Description of Artificial Sequence: Synthetic peptide
  Seed: ALYVDSLFFLRGRLDQLLRHVMNPL (PRAME_HUMAN)
  Core: FLRGRLDQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFXLRXRXDQXLRHVMNPL

SEQ ID NO: 348946 - protein, 25 aa, Artificial Sequence
  Description of Artificial Sequence: Synthetic peptide
  Seed: ALYVDSLFFLRGRLDQLLRHVMNPL (PRAME_HUMAN)
  Core: LRGRLDQLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFXRGXLXQLXRHVMNPL

SEQ ID NO: 348947 - protein, 25 aa, Artificial Sequence
  Description of Artificial Sequence: Synthetic peptide
  Seed: ALYVDSLFFLRGRLDQLLRHVMNPL (PRAME_HUMAN)
  Core: RLDQLLRHV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGXLDXLXRHXMNPL

SEQ ID NO: 348948 - protein, 25 aa, Artificial Sequence
  Description of Artificial Sequence: Synthetic peptide
  Seed: ALYVDSLFFLRGRLDQLLRHVMNPL (PRAME_HUMAN)
  Core: LDQLLRHVM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALYVDSLFFLRGRXDQXLXHVXNPL

SEQ ID NO: 348949 - protein, 14 aa, Artificial Sequence
  Description of Artificial Sequence: Synthetic peptide
  Seed: AMPMQDIKMILKMV (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMV

SEQ ID NO: 348950 - protein, 15 aa, Artificial Sequence
  Description of Artificial Sequence: Synthetic peptide
  Seed: AMPMQDIKMILKMVQ (PRAME_HUMAN)
  Core: PMQDIKMIL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXMQXIXMIXKMVQ

SEQ ID NO: 348951 - protein, 15 aa, Artificial Sequence
  Description of Artificial Sequence: Synthetic peptide
  Seed: AMPMQDIKMILKMVQ (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMVQ

SEQ ID NO: 348952 - protein, 15 aa, Artificial Sequence
  Description of Artificial Sequence: Synthetic peptide
  Seed: AMPMQDIKMILKMVQ (PRAME_HUMAN)
  Core: QDIKMILKM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMPMXDIXMXLKXVQ

SEQ ID NO: 348953 - protein, 15 aa, Artificial Sequence
  Description of Artificial Sequence: Synthetic peptide
  Seed: AMPMQDIKMILKMVQ (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVX

SEQ ID NO: 348954 - protein, 16 aa, Artificial Sequence
  Description of Artificial Sequence: Synthetic peptide
  Seed: AMPMQDIKMILKMVQL (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMVQL

SEQ ID NO: 348955 - protein, 16 aa, Artificial Sequence
  Description of Artificial Sequence: Synthetic peptide
  Seed: AMPMQDIKMILKMVQL (PRAME_HUMAN)
  Core: QDIKMILKM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMPMXDIXMXLKXVQL

SEQ ID NO: 348956 - protein, 16 aa, Artificial Sequence
  Description of Artificial Sequence: Synthetic peptide
  Seed: AMPMQDIKMILKMVQL (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXL

SEQ ID NO: 348957 - protein, 17 aa, Artificial Sequence
  Description of Artificial Sequence: Synthetic peptide
  Seed: AMPMQDIKMILKMVQLD (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMVQLD

SEQ ID NO: 348958 - protein, 17 aa, Artificial Sequence
  Description of Artificial Sequence: Synthetic peptide
  Seed: AMPMQDIKMILKMVQLD (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLD

SEQ ID NO: 348959 - protein, 17 aa, Artificial Sequence
  Description of Artificial Sequence: Synthetic peptide
  Seed: AMPMQDIKMILKMVQLD (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLX

SEQ ID NO: 348960 - protein, 18 aa, Artificial Sequence
  Description of Artificial Sequence: Synthetic peptide
  Seed: AMPMQDIKMILKMVQLDS (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMVQLDS

SEQ ID NO: 348961 - protein, 18 aa, Artificial Sequence
  Description of Artificial Sequence: Synthetic peptide
  Seed: AMPMQDIKMILKMVQLDS (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDS

SEQ ID NO: 348962 - protein, 18 aa, Artificial Sequence
  Description of Artificial Sequence: Synthetic peptide
  Seed: AMPMQDIKMILKMVQLDS (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXS

SEQ ID NO: 348963 - protein, 19 aa, Artificial Sequence
  Description of Artificial Sequence: Synthetic peptide
  Seed: AMPMQDIKMILKMVQLDSI (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSI

SEQ ID NO: 348964 - protein, 19 aa, Artificial Sequence
  Description of Artificial Sequence: Synthetic peptide
  Seed: AMPMQDIKMILKMVQLDSI (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSI

SEQ ID NO: 348965 - protein, 19 aa, Artificial Sequence
  Description of Artificial Sequence: Synthetic peptide
  Seed: AMPMQDIKMILKMVQLDSI (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSX

SEQ ID NO: 348966 - protein, 20 aa, Artificial Sequence
  Description of Artificial Sequence: Synthetic peptide
  Seed: AMPMQDIKMILKMVQLDSIE (PRAME_HUMAN)
  Core: MQDIKMILK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AMPXQDXKXILXMVQLDSIE

SEQ ID NO: 348967 - protein, 20 aa, Artificial Sequence
  Description of Artificial Sequence: Synthetic peptide
  Seed: AMPMQDIKMILKMVQLDSIE (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIE

SEQ ID NO: 348968 - protein, 20 aa, Artificial Sequence
  Description of Artificial Sequence: Synthetic peptide
  Seed: AMPMQDIKMILKMVQLDSIE (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIE

SEQ ID NO: 348969 - protein, 20 aa, Artificial Sequence
  Description of Artificial Sequence: Synthetic peptide
  Seed: AMPMQDIKMILKMVQLDSIE (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXE

SEQ ID NO: 348970 - protein, 21 aa, Artificial Sequence
  Description of Artificial Sequence: Synthetic peptide
  Seed: AMPMQDIKMILKMVQLDSIED (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIED

SEQ ID NO: 348971 - protein, 21 aa, Artificial Sequence
  Description of Artificial Sequence: Synthetic peptide
  Seed: AMPMQDIKMILKMVQLDSIED (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIED

SEQ ID NO: 348972 - protein, 21 aa, Artificial Sequence
  Description of Artificial Sequence: Synthetic peptide
  Seed: AMPMQDIKMILKMVQLDSIED (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXED

SEQ ID NO: 348973 - protein, 21 aa, Artificial Sequence
  Description of Artificial Sequence: Synthetic peptide
  Seed: AMPMQDIKMILKMVQLDSIED (PRAME_HUMAN)
  Core: MVQLDSIED
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKXVQXDXIEX

SEQ ID NO: 348974 - protein, 22 aa, Artificial Sequence
  Description of Artificial Sequence: Synthetic peptide
  Seed: AMPMQDIKMILKMVQLDSIEDL (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIEDL

SEQ ID NO: 348975 - protein, 22 aa, Artificial Sequence
  Description of Artificial Sequence: Synthetic peptide
  Seed: AMPMQDIKMILKMVQLDSIEDL (PRAME_HUMAN)
  Core: KMILKMVQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIXMIXKXVQXDSIEDL

SEQ ID NO: 348976 - protein, 22 aa, Artificial Sequence
  Description of Artificial Sequence: Synthetic peptide
  Seed: AMPMQDIKMILKMVQLDSIEDL (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIEDL

SEQ ID NO: 348977 - protein, 22 aa, Artificial Sequence
  Description of Artificial Sequence: Synthetic peptide
  Seed: AMPMQDIKMILKMVQLDSIEDL (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXEDL

SEQ ID NO: 348978 - protein, 22 aa, Artificial Sequence
  Description of Artificial Sequence: Synthetic peptide
  Seed: AMPMQDIKMILKMVQLDSIEDL (PRAME_HUMAN)
  Core: MVQLDSIED
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKXVQXDXIEXL

SEQ ID NO: 348979 - protein, 23 aa, Artificial Sequence
  Description of Artificial Sequence: Synthetic peptide
  Seed: AMPMQDIKMILKMVQLDSIEDLE (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIEDLE

SEQ ID NO: 348980 - protein, 23 aa, Artificial Sequence
  Description of Artificial Sequence: Synthetic peptide
  Seed: AMPMQDIKMILKMVQLDSIEDLE (PRAME_HUMAN)
  Core: KMILKMVQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIXMIXKXVQXDSIEDLE

SEQ ID NO: 348981 - protein, 23 aa, Artificial Sequence
  Description of Artificial Sequence: Synthetic peptide
  Seed: AMPMQDIKMILKMVQLDSIEDLE (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIEDLE

SEQ ID NO: 348982 - protein, 23 aa, Artificial Sequence
  Description of Artificial Sequence: Synthetic peptide
  Seed: AMPMQDIKMILKMVQLDSIEDLE (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXEDLE

SEQ ID NO: 348983 - protein, 23 aa, Artificial Sequence
  Description of Artificial Sequence: Synthetic peptide
  Seed: AMPMQDIKMILKMVQLDSIEDLE (PRAME_HUMAN)
  Core: MVQLDSIED
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKXVQXDXIEXLE

SEQ ID NO: 348984 - protein, 24 aa, Artificial Sequence
  Description of Artificial Sequence: Synthetic peptide
  Seed: AMPMQDIKMILKMVQLDSIEDLEV (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIEDLEV

SEQ ID NO: 348985 - protein, 24 aa, Artificial Sequence
  Description of Artificial Sequence: Synthetic peptide
  Seed: AMPMQDIKMILKMVQLDSIEDLEV (PRAME_HUMAN)
  Core: KMILKMVQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIXMIXKXVQXDSIEDLEV

SEQ ID NO: 348986 - protein, 24 aa, Artificial Sequence
  Description of Artificial Sequence: Synthetic peptide
  Seed: AMPMQDIKMILKMVQLDSIEDLEV (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIEDLEV

SEQ ID NO: 348987 - protein, 24 aa, Artificial Sequence
  Description of Artificial Sequence: Synthetic peptide
  Seed: AMPMQDIKMILKMVQLDSIEDLEV (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXEDLEV

SEQ ID NO: 348988 - protein, 24 aa, Artificial Sequence
  Description of Artificial Sequence: Synthetic peptide
  Seed: AMPMQDIKMILKMVQLDSIEDLEV (PRAME_HUMAN)
  Core: MVQLDSIED
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKXVQXDXIEXLEV

SEQ ID NO: 348989 - protein, 24 aa, Artificial Sequence
  Description of Artificial Sequence: Synthetic peptide
  Seed: AMPMQDIKMILKMVQLDSIEDLEV (PRAME_HUMAN)
  Core: VQLDSIEDL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKMXQLXSXEDXEV

SEQ ID NO: 348990 - protein, 24 aa, Artificial Sequence
  Description of Artificial Sequence: Synthetic peptide
  Seed: AMPMQDIKMILKMVQLDSIEDLEV (PRAME_HUMAN)
  Core: LDSIEDLEV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKMVQXDSXEXLEX

SEQ ID NO: 348991 - protein, 25 aa, Artificial Sequence
  Description of Artificial Sequence: Synthetic peptide
  Seed: AMPMQDIKMILKMVQLDSIEDLEVT (PRAME_HUMAN)
  Core: IKMILKMVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDXKMXLXMVXLDSIEDLEVT

SEQ ID NO: 348992 - protein, 25 aa, Artificial Sequence
  Description of Artificial Sequence: Synthetic peptide
  Seed: AMPMQDIKMILKMVQLDSIEDLEVT (PRAME_HUMAN)
  Core: KMILKMVQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIXMIXKXVQXDSIEDLEVT

SEQ ID NO: 348993 - protein, 25 aa, Artificial Sequence
  Description of Artificial Sequence: Synthetic peptide
  Seed: AMPMQDIKMILKMVQLDSIEDLEVT (PRAME_HUMAN)
  Core: MILKMVQLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKXILXMXQLXSIEDLEVT

SEQ ID NO: 348994 - protein, 25 aa, Artificial Sequence
  Description of Artificial Sequence: Synthetic peptide
  Seed: AMPMQDIKMILKMVQLDSIEDLEVT (PRAME_HUMAN)
  Core: LKMVQLDSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMIXKMXQXDSXEDLEVT

SEQ ID NO: 348995 - protein, 25 aa, Artificial Sequence
  Description of Artificial Sequence: Synthetic peptide
  Seed: AMPMQDIKMILKMVQLDSIEDLEVT (PRAME_HUMAN)
  Core: MVQLDSIED
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKXVQXDXIEXLEVT

SEQ ID NO: 348996 - protein, 25 aa, Artificial Sequence
  Description of Artificial Sequence: Synthetic peptide
  Seed: AMPMQDIKMILKMVQLDSIEDLEVT (PRAME_HUMAN)
  Core: VQLDSIEDL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKMXQLXSXEDXEVT

SEQ ID NO: 348997 - protein, 25 aa, Artificial Sequence
  Description of Artificial Sequence: Synthetic peptide
  Seed: AMPMQDIKMILKMVQLDSIEDLEVT (PRAME_HUMAN)
  Core: LDSIEDLEV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AMPMQDIKMILKMVQXDSXEXLEXT

SEQ ID NO: 348998 - protein, 13 aa, Artificial Sequence
  Description of Artificial Sequence: Synthetic peptide
  Seed: AMVQAWPFTCLPL (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPL

SEQ ID NO: 348999 - protein, 14 aa, Artificial Sequence
  Description of Artificial Sequence: Synthetic peptide
  Seed: AMVQAWPFTCLPLG (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLG

SEQ ID NO: 349000 - protein, 14 aa, Artificial Sequence
  Description of Artificial Sequence: Synthetic peptide
  Seed: AMVQAWPFTCLPLG (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXG

SEQ ID NO: 349001 - protein, 15 aa, Artificial Sequence
  Description of Artificial Sequence: Synthetic peptide
  Seed: AMVQAWPFTCLPLGV (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGV

SEQ ID NO: 349002 - protein, 15 aa, Artificial Sequence
  Description of Artificial Sequence: Synthetic peptide
  Seed: AMVQAWPFTCLPLGV (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGV

SEQ ID NO: 349003 - protein, 15 aa, Artificial Sequence
  Description of Artificial Sequence: Synthetic peptide
  Seed: AMVQAWPFTCLPLGV (PRAME_HUMAN)
  Core: PFTCLPLGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWXFTXLXLGX

SEQ ID NO: 349004 - protein, 16 aa, Artificial Sequence
  Description of Artificial Sequence: Synthetic peptide
  Seed: AMVQAWPFTCLPLGVL (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVL

SEQ ID NO: 349005 - protein, 16 aa, Artificial Sequence
  Description of Artificial Sequence: Synthetic peptide
  Seed: AMVQAWPFTCLPLGVL (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVL

SEQ ID NO: 349006 - protein, 16 aa, Artificial Sequence
  Description of Artificial Sequence: Synthetic peptide
  Seed: AMVQAWPFTCLPLGVL (PRAME_HUMAN)
  Core: PFTCLPLGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWXFTXLXLGXL

SEQ ID NO: 349007 - protein, 16 aa, Artificial Sequence
  Description of Artificial Sequence: Synthetic peptide
  Seed: AMVQAWPFTCLPLGVL (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVX

SEQ ID NO: 349008 - protein, 17 aa, Artificial Sequence
  Description of Artificial Sequence: Synthetic peptide
  Seed: AMVQAWPFTCLPLGVLM (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLM

SEQ ID NO: 349009 - protein, 17 aa, Artificial Sequence
  Description of Artificial Sequence: Synthetic peptide
  Seed: AMVQAWPFTCLPLGVLM (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLM

SEQ ID NO: 349010 - protein, 17 aa, Artificial Sequence
  Description of Artificial Sequence: Synthetic peptide
  Seed: AMVQAWPFTCLPLGVLM (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXM

SEQ ID NO: 349011 - protein, 18 aa, Artificial Sequence
  Description of Artificial Sequence: Synthetic peptide
  Seed: AMVQAWPFTCLPLGVLMK (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMK

SEQ ID NO: 349012 - protein, 18 aa, Artificial Sequence
  Description of Artificial Sequence: Synthetic peptide
  Seed: AMVQAWPFTCLPLGVLMK (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMK

SEQ ID NO: 349013 - protein, 18 aa, Artificial Sequence
  Description of Artificial Sequence: Synthetic peptide
  Seed: AMVQAWPFTCLPLGVLMK (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMK

SEQ ID NO: 349014 - protein, 19 aa, Artificial Sequence
  Description of Artificial Sequence: Synthetic peptide
  Seed: AMVQAWPFTCLPLGVLMKG (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKG

SEQ ID NO: 349015 - protein, 19 aa, Artificial Sequence
  Description of Artificial Sequence: Synthetic peptide
  Seed: AMVQAWPFTCLPLGVLMKG (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKG

SEQ ID NO: 349016 - protein, 19 aa, Artificial Sequence
  Description of Artificial Sequence: Synthetic peptide
  Seed: AMVQAWPFTCLPLGVLMKG (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKG

SEQ ID NO: 349017 - protein, 20 aa, Artificial Sequence
  Description of Artificial Sequence: Synthetic peptide
  Seed: AMVQAWPFTCLPLGVLMKGQ (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQ

SEQ ID NO: 349018 - protein, 20 aa, Artificial Sequence
  Description of Artificial Sequence: Synthetic peptide
  Seed: AMVQAWPFTCLPLGVLMKGQ (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKGQ

SEQ ID NO: 349019 - protein, 20 aa, Artificial Sequence
  Description of Artificial Sequence: Synthetic peptide
  Seed: AMVQAWPFTCLPLGVLMKGQ (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQ

SEQ ID NO: 349020 - protein, 21 aa, Artificial Sequence
  Description of Artificial Sequence: Synthetic peptide
  Seed: AMVQAWPFTCLPLGVLMKGQH (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQH

SEQ ID NO: 349021 - protein, 21 aa, Artificial Sequence
  Description of Artificial Sequence: Synthetic peptide
  Seed: AMVQAWPFTCLPLGVLMKGQH (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKGQH

SEQ ID NO: 349022 - protein, 21 aa, Artificial Sequence
  Description of Artificial Sequence: Synthetic peptide
  Seed: AMVQAWPFTCLPLGVLMKGQH (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQH

SEQ ID NO: 349023 - protein, 21 aa, Artificial Sequence
  Description of Artificial Sequence: Synthetic peptide
  Seed: AMVQAWPFTCLPLGVLMKGQH (PRAME_HUMAN)
  Core: CLPLGVLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTXLPXGXLMXGQH

SEQ ID NO: 349024 - protein, 22 aa, Artificial Sequence
  Description of Artificial Sequence: Synthetic peptide
  Seed: AMVQAWPFTCLPLGVLMKGQHL (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQHL

SEQ ID NO: 349025 - protein, 22 aa, Artificial Sequence
  Description of Artificial Sequence: Synthetic peptide
  Seed: AMVQAWPFTCLPLGVLMKGQHL (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKGQHL

SEQ ID NO: 349026 - protein, 22 aa, Artificial Sequence
  Description of Artificial Sequence: Synthetic peptide
  Seed: AMVQAWPFTCLPLGVLMKGQHL (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQHL

SEQ ID NO: 349027 - protein, 22 aa, Artificial Sequence
  Description of Artificial Sequence: Synthetic peptide
  Seed: AMVQAWPFTCLPLGVLMKGQHL (PRAME_HUMAN)
  Core: CLPLGVLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTXLPXGXLMXGQHL

SEQ ID NO: 349028 - protein, 22 aa, Artificial Sequence
  Description of Artificial Sequence: Synthetic peptide
  Seed: AMVQAWPFTCLPLGVLMKGQHL (PRAME_HUMAN)
  Core: LGVLMKGQH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPXGVXMXGQXL

SEQ ID NO: 349029 - protein, 23 aa, Artificial Sequence
  Description of Artificial Sequence: Synthetic peptide
  Seed: AMVQAWPFTCLPLGVLMKGQHLH (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQHLH

SEQ ID NO: 349030 - protein, 23 aa, Artificial Sequence
  Description of Artificial Sequence: Synthetic peptide
  Seed: AMVQAWPFTCLPLGVLMKGQHLH (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKGQHLH

SEQ ID NO: 349031 - protein, 23 aa, Artificial Sequence
  Description of Artificial Sequence: Synthetic peptide
  Seed: AMVQAWPFTCLPLGVLMKGQHLH (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQHLH

SEQ ID NO: 349032 - protein, 23 aa, Artificial Sequence
  Description of Artificial Sequence: Synthetic peptide
  Seed: AMVQAWPFTCLPLGVLMKGQHLH (PRAME_HUMAN)
  Core: LGVLMKGQH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPXGVXMXGQXLH

SEQ ID NO: 349033 - protein, 23 aa, Artificial Sequence
  Description of Artificial Sequence: Synthetic peptide
  Seed: AMVQAWPFTCLPLGVLMKGQHLH (PRAME_HUMAN)
  Core: GVLMKGQHL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLXVLXKXQHXH

SEQ ID NO: 349034 - protein, 23 aa, Artificial Sequence
  Description of Artificial Sequence: Synthetic peptide
  Seed: AMVQAWPFTCLPLGVLMKGQHLH (PRAME_HUMAN)
  Core: VLMKGQHLH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLGXLMXGXHLX

SEQ ID NO: 349035 - protein, 24 aa, Artificial Sequence
  Description of Artificial Sequence: Synthetic peptide
  Seed: AMVQAWPFTCLPLGVLMKGQHLHL (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQHLHL

SEQ ID NO: 349036 - protein, 24 aa, Artificial Sequence
  Description of Artificial Sequence: Synthetic peptide
  Seed: AMVQAWPFTCLPLGVLMKGQHLHL (PRAME_HUMAN)
  Core: AWPFTCLPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMVQXWPXTXLPXGVLMKGQHLHL

SEQ ID NO: 349037 - protein, 24 aa, Artificial Sequence
  Description of Artificial Sequence: Synthetic peptide
  Seed: AMVQAWPFTCLPLGVLMKGQHLHL (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQHLHL

SEQ ID NO: 349038 - protein, 24 aa, Artificial Sequence
  Description of Artificial Sequence: Synthetic peptide
  Seed: AMVQAWPFTCLPLGVLMKGQHLHL (PRAME_HUMAN)
  Core: LGVLMKGQH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPXGVXMXGQXLHL

SEQ ID NO: 349039 - protein, 24 aa, Artificial Sequence
  Description of Artificial Sequence: Synthetic peptide
  Seed: AMVQAWPFTCLPLGVLMKGQHLHL (PRAME_HUMAN)
  Core: GVLMKGQHL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLXVLXKXQHXHL

SEQ ID NO: 349040 - protein, 24 aa, Artificial Sequence
  Description of Artificial Sequence: Synthetic peptide
  Seed: AMVQAWPFTCLPLGVLMKGQHLHL (PRAME_HUMAN)
  Core: VLMKGQHLH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLGXLMXGXHLXL

SEQ ID NO: 349041 - protein, 25 aa, Artificial Sequence
  Description of Artificial Sequence: Synthetic peptide
  Seed: AMVQAWPFTCLPLGVLMKGQHLHLE (PRAME_HUMAN)
  Core: VQAWPFTCL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXQAXPXTCXPLGVLMKGQHLHLE

SEQ ID NO: 349042 - protein, 25 aa, Artificial Sequence
  Description of Artificial Sequence: Synthetic peptide
  Seed: AMVQAWPFTCLPLGVLMKGQHLHLE (PRAME_HUMAN)
  Core: FTCLPLGVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPXTCXPXGVXMKGQHLHLE

SEQ ID NO: 349043 - protein, 25 aa, Artificial Sequence
  Description of Artificial Sequence: Synthetic peptide
  Seed: AMVQAWPFTCLPLGVLMKGQHLHLE (PRAME_HUMAN)
  Core: GVLMKGQHL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLXVLXKXQHXHLE

SEQ ID NO: 349044 - protein, 25 aa, Artificial Sequence
  Description of Artificial Sequence: Synthetic peptide
  Seed: AMVQAWPFTCLPLGVLMKGQHLHLE (PRAME_HUMAN)
  Core: VLMKGQHLH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMVQAWPFTCLPLGXLMXGXHLXLE

SEQ ID NO: 349045 - protein, 15 aa, Artificial Sequence
  Description of Artificial Sequence: Synthetic peptide
  Seed: AQEVRPRRWKLQVLD (PRAME_HUMAN)
  Core: VRPRRWKLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQEXRPXRXKLXVLD

SEQ ID NO: 349046 - protein, 15 aa, Artificial Sequence
  Description of Artificial Sequence: Synthetic peptide
  Seed: AQEVRPRRWKLQVLD (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXD

SEQ ID NO: 349047 - protein, 16 aa, Artificial Sequence
  Description of Artificial Sequence: Synthetic peptide
  Seed: AQEVRPRRWKLQVLDL (PRAME_HUMAN)
  Core: VRPRRWKLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQEXRPXRXKLXVLDL

SEQ ID NO: 349048 - protein, 16 aa, Artificial Sequence
  Description of Artificial Sequence: Synthetic peptide
  Seed: AQEVRPRRWKLQVLDL (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDL

SEQ ID NO: 349049 - protein, 16 aa, Artificial Sequence
  Description of Artificial Sequence: Synthetic peptide
  Seed: AQEVRPRRWKLQVLDL (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXL

SEQ ID NO: 349050 - protein, 17 aa, Artificial Sequence
  Description of Artificial Sequence: Synthetic peptide
  Seed: AQEVRPRRWKLQVLDLR (PRAME_HUMAN)
  Core: VRPRRWKLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQEXRPXRXKLXVLDLR

SEQ ID NO: 349051 - protein, 17 aa, Artificial Sequence
  Description of Artificial Sequence: Synthetic peptide
  Seed: AQEVRPRRWKLQVLDLR (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLR

SEQ ID NO: 349052 - protein, 17 aa, Artificial Sequence
  Description of Artificial Sequence: Synthetic peptide
  Seed: AQEVRPRRWKLQVLDLR (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLR

SEQ ID NO: 349053 - protein, 17 aa, Artificial Sequence
  Description of Artificial Sequence: Synthetic peptide
  Seed: AQEVRPRRWKLQVLDLR (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXR

SEQ ID NO: 349054 - protein, 18 aa, Artificial Sequence
  Description of Artificial Sequence: Synthetic peptide
  Seed: AQEVRPRRWKLQVLDLRK (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRK

SEQ ID NO: 349055 - protein, 18 aa, Artificial Sequence
  Description of Artificial Sequence: Synthetic peptide
  Seed: AQEVRPRRWKLQVLDLRK (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRK

SEQ ID NO: 349056 - protein, 18 aa, Artificial Sequence
  Description of Artificial Sequence: Synthetic peptide
  Seed: AQEVRPRRWKLQVLDLRK (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRK

SEQ ID NO: 349057 - protein, 18 aa, Artificial Sequence
  Description of Artificial Sequence: Synthetic peptide
  Seed: AQEVRPRRWKLQVLDLRK (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXK

SEQ ID NO: 349058 - protein, 19 aa, Artificial Sequence
  Description of Artificial Sequence: Synthetic peptide
  Seed: AQEVRPRRWKLQVLDLRKN (PRAME_HUMAN)
  Core: VRPRRWKLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQEXRPXRXKLXVLDLRKN

SEQ ID NO: 349059 - protein, 19 aa, Artificial Sequence
  Description of Artificial Sequence: Synthetic peptide
  Seed: AQEVRPRRWKLQVLDLRKN (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKN

SEQ ID NO: 349060 - protein, 19 aa, Artificial Sequence
  Description of Artificial Sequence: Synthetic peptide
  Seed: AQEVRPRRWKLQVLDLRKN (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKN

SEQ ID NO: 349061 - protein, 19 aa, Artificial Sequence
  Description of Artificial Sequence: Synthetic peptide
  Seed: AQEVRPRRWKLQVLDLRKN (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKN

SEQ ID NO: 349062 - protein, 19 aa, Artificial Sequence
  Description of Artificial Sequence: Synthetic peptide
  Seed: AQEVRPRRWKLQVLDLRKN (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKN

SEQ ID NO: 349063 - protein, 20 aa, Artificial Sequence
  Description of Artificial Sequence: Synthetic peptide
  Seed: AQEVRPRRWKLQVLDLRKNS (PRAME_HUMAN)
  Core: VRPRRWKLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQEXRPXRXKLXVLDLRKNS

SEQ ID NO: 349064 - protein, 20 aa, Artificial Sequence
  Description of Artificial Sequence: Synthetic peptide
  Seed: AQEVRPRRWKLQVLDLRKNS (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNS

SEQ ID NO: 349065 - protein, 20 aa, Artificial Sequence
  Description of Artificial Sequence: Synthetic peptide
  Seed: AQEVRPRRWKLQVLDLRKNS (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNS

SEQ ID NO: 349066 - protein, 20 aa, Artificial Sequence
  Description of Artificial Sequence: Synthetic peptide
  Seed: AQEVRPRRWKLQVLDLRKNS (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNS

SEQ ID NO: 349067 - protein, 20 aa, Artificial Sequence
  Description of Artificial Sequence: Synthetic peptide
  Seed: AQEVRPRRWKLQVLDLRKNS (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNS

SEQ ID NO: 349068 - protein, 20 aa, Artificial Sequence
  Description of Artificial Sequence: Synthetic peptide
  Seed: AQEVRPRRWKLQVLDLRKNS (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXS

SEQ ID NO: 349069 - protein, 21 aa, Artificial Sequence
  Description of Artificial Sequence: Synthetic peptide
  Seed: AQEVRPRRWKLQVLDLRKNSH (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNSH

SEQ ID NO: 349070 - protein, 21 aa, Artificial Sequence
  Description of Artificial Sequence: Synthetic peptide
  Seed: AQEVRPRRWKLQVLDLRKNSH (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNSH

SEQ ID NO: 349071 - protein, 21 aa, Artificial Sequence
  Description of Artificial Sequence: Synthetic peptide
  Seed: AQEVRPRRWKLQVLDLRKNSH (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNSH

SEQ ID NO: 349072 - protein, 21 aa, Artificial Sequence
  Description of Artificial Sequence: Synthetic peptide
  Seed: AQEVRPRRWKLQVLDLRKNSH (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNSH

SEQ ID NO: 349073 - protein, 21 aa, Artificial Sequence
  Description of Artificial Sequence: Synthetic peptide
  Seed: AQEVRPRRWKLQVLDLRKNSH (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXSH

SEQ ID NO: 349074 - protein, 22 aa, Artificial Sequence
  Description of Artificial Sequence: Synthetic peptide
  Seed: AQEVRPRRWKLQVLDLRKNSHQ (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNSHQ

SEQ ID NO: 349075 - protein, 22 aa, Artificial Sequence
  Description of Artificial Sequence: Synthetic peptide
  Seed: AQEVRPRRWKLQVLDLRKNSHQ (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNSHQ

SEQ ID NO: 349076 - protein, 22 aa, Artificial Sequence
  Description of Artificial Sequence: Synthetic peptide
  Seed: AQEVRPRRWKLQVLDLRKNSHQ (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNSHQ

SEQ ID NO: 349077 - protein, 22 aa, Artificial Sequence
  Description of Artificial Sequence: Synthetic peptide
  Seed: AQEVRPRRWKLQVLDLRKNSHQ (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNSHQ

SEQ ID NO: 349078 - protein, 22 aa, Artificial Sequence
  Description of Artificial Sequence: Synthetic peptide
  Seed: AQEVRPRRWKLQVLDLRKNSHQ (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXSHQ

SEQ ID NO: 349079 - protein, 22 aa, Artificial Sequence
  Description of Artificial Sequence: Synthetic peptide
  Seed: AQEVRPRRWKLQVLDLRKNSHQ (PRAME_HUMAN)
  Core: VLDLRKNSH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKLQXLDXRXNSXQ

SEQ ID NO: 349080 - protein, 23 aa, Artificial Sequence
  Description of Artificial Sequence: Synthetic peptide
  Seed: AQEVRPRRWKLQVLDLRKNSHQD (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNSHQD

SEQ ID NO: 349081 - protein, 23 aa, Artificial Sequence
  Description of Artificial Sequence: Synthetic peptide
  Seed: AQEVRPRRWKLQVLDLRKNSHQD (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNSHQD

SEQ ID NO: 349082 - protein, 23 aa, Artificial Sequence
  Description of Artificial Sequence: Synthetic peptide
  Seed: AQEVRPRRWKLQVLDLRKNSHQD (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNSHQD

SEQ ID NO: 349083 - protein, 23 aa, Artificial Sequence
  Description of Artificial Sequence: Synthetic peptide
  Seed: AQEVRPRRWKLQVLDLRKNSHQD (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNSHQD

SEQ ID NO: 349084 - protein, 23 aa, Artificial Sequence
  Description of Artificial Sequence: Synthetic peptide
  Seed: AQEVRPRRWKLQVLDLRKNSHQD (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXSHQD

SEQ ID NO: 349085 - protein, 23 aa, Artificial Sequence
  Description of Artificial Sequence: Synthetic peptide
  Seed: AQEVRPRRWKLQVLDLRKNSHQD (PRAME_HUMAN)
  Core: VLDLRKNSH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKLQXLDXRXNSXQD

SEQ ID NO: 349086 - protein, 24 aa, Artificial Sequence
  Description of Artificial Sequence: Synthetic peptide
  Seed: AQEVRPRRWKLQVLDLRKNSHQDF (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNSHQDF

SEQ ID NO: 349087 - protein, 24 aa, Artificial Sequence
  Description of Artificial Sequence: Synthetic peptide
  Seed: AQEVRPRRWKLQVLDLRKNSHQDF (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNSHQDF

SEQ ID NO: 349088 - protein, 24 aa, Artificial Sequence
  Description of Artificial Sequence: Synthetic peptide
  Seed: AQEVRPRRWKLQVLDLRKNSHQDF (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNSHQDF

SEQ ID NO: 349089 - protein, 24 aa, Artificial Sequence
  Description of Artificial Sequence: Synthetic peptide
  Seed: AQEVRPRRWKLQVLDLRKNSHQDF (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNSHQDF

SEQ ID NO: 349090 - protein, 24 aa, Artificial Sequence
  Description of Artificial Sequence: Synthetic peptide
  Seed: AQEVRPRRWKLQVLDLRKNSHQDF (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXSHQDF

SEQ ID NO: 349091 - protein, 24 aa, Artificial Sequence
  Description of Artificial Sequence: Synthetic peptide
  Seed: AQEVRPRRWKLQVLDLRKNSHQDF (PRAME_HUMAN)
  Core: VLDLRKNSH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKLQXLDXRXNSXQDF

SEQ ID NO: 349092 - protein, 25 aa, Artificial Sequence
  Description of Artificial Sequence: Synthetic peptide
  Seed: AQEVRPRRWKLQVLDLRKNSHQDFW (PRAME_HUMAN)
  Core: PRRWKLQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRXRRXKXQVXDLRKNSHQDFW

SEQ ID NO: 349093 - protein, 25 aa, Artificial Sequence
  Description of Artificial Sequence: Synthetic peptide
  Seed: AQEVRPRRWKLQVLDLRKNSHQDFW (PRAME_HUMAN)
  Core: RRWKLQVLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPXRWXLXVLXLRKNSHQDFW

SEQ ID NO: 349094 - protein, 25 aa, Artificial Sequence
  Description of Artificial Sequence: Synthetic peptide
  Seed: AQEVRPRRWKLQVLDLRKNSHQDFW (PRAME_HUMAN)
  Core: RWKLQVLDL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRXWKXQXLDXRKNSHQDFW

SEQ ID NO: 349095 - protein, 25 aa, Artificial Sequence
  Description of Artificial Sequence: Synthetic peptide
  Seed: AQEVRPRRWKLQVLDLRKNSHQDFW (PRAME_HUMAN)
  Core: WKLQVLDLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRXKLXVXDLXKNSHQDFW

SEQ ID NO: 349096 - protein, 25 aa, Artificial Sequence
  Description of Artificial Sequence: Synthetic peptide
  Seed: AQEVRPRRWKLQVLDLRKNSHQDFW (PRAME_HUMAN)
  Core: LQVLDLRKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKXQVXDXRKXSHQDFW

SEQ ID NO: 349097 - protein, 25 aa, Artificial Sequence
  Description of Artificial Sequence: Synthetic peptide
  Seed: AQEVRPRRWKLQVLDLRKNSHQDFW (PRAME_HUMAN)
  Core: VLDLRKNSH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKLQXLDXRXNSXQDFW

SEQ ID NO: 349098 - protein, 25 aa, Artificial Sequence
  Description of Artificial Sequence: Synthetic peptide
  Seed: AQEVRPRRWKLQVLDLRKNSHQDFW (PRAME_HUMAN)
  Core: LRKNSHQDF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AQEVRPRRWKLQVLDXRKXSXQDXW

SEQ ID NO: 349099 - protein, 13 aa, Artificial Sequence
  Description of Artificial Sequence: Synthetic peptide
  Seed: AQFTSQFLSLQCL (PRAME_HUMAN)
  Core: QFTSQFLSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXFTXQXLSXQCL

SEQ ID NO: 349100 - protein, 13 aa, Artificial Sequence
  Description of Artificial Sequence: Synthetic peptide
  Seed: AQFTSQFLSLQCL (PRAME_HUMAN)
  Core: FTSQFLSLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AQXTSXFXSLXCL

SEQ ID NO: 349101 - protein, 14 aa, Artificial Sequence
  Description of Artificial Sequence: Synthetic peptide
  Seed: AQFTSQFLSLQCLQ (PRAME_HUMAN)
  Core: QFTSQFLSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXFTXQXLSXQCLQ

SEQ ID NO: 349102 - protein, 14 aa, Artificial Sequence
  Description of Artificial Sequence: Synthetic peptide
  Seed: AQFTSQFLSLQCLQ (PRAME_HUMAN)
  Core: FTSQFLSLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AQXTSXFXSLXCLQ

SEQ ID NO: 349103 - protein, 14 aa, Artificial Sequence
  Description of Artificial Sequence: Synthetic peptide
  Seed: AQFTSQFLSLQCLQ (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQ

SEQ ID NO: 349104 - protein, 15 aa, Artificial Sequence
  Description of Artificial Sequence: Synthetic peptide
  Seed: AQFTSQFLSLQCLQA (PRAME_HUMAN)
  Core: QFTSQFLSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXFTXQXLSXQCLQA

SEQ ID NO: 349105 - protein, 15 aa, Artificial Sequence
  Description of Artificial Sequence: Synthetic peptide
  Seed: AQFTSQFLSLQCLQA (PRAME_HUMAN)
  Core: FTSQFLSLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AQXTSXFXSLXCLQA

SEQ ID NO: 349106 - protein, 15 aa, Artificial Sequence
  Description of Artificial Sequence: Synthetic peptide
  Seed: AQFTSQFLSLQCLQA (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQA

SEQ ID NO: 349107 - protein, 15 aa, Artificial Sequence
  Description of Artificial Sequence: Synthetic peptide
  Seed: AQFTSQFLSLQCLQA (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQX

SEQ ID NO: 349108 - protein, 16 aa, Artificial Sequence
  Description of Artificial Sequence: Synthetic peptide
  Seed: AQFTSQFLSLQCLQAL (PRAME_HUMAN)
  Core: QFTSQFLSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXFTXQXLSXQCLQAL

SEQ ID NO: 349109 - protein, 16 aa, Artificial Sequence
  Description of Artificial Sequence: Synthetic peptide
  Seed: AQFTSQFLSLQCLQAL (PRAME_HUMAN)
  Core: FTSQFLSLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AQXTSXFXSLXCLQAL

SEQ ID NO: 349110 - protein, 16 aa, Artificial Sequence
  Description of Artificial Sequence: Synthetic peptide
  Seed: AQFTSQFLSLQCLQAL (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQAL

SEQ ID NO: 349111 - protein, 16 aa, Artificial Sequence
  Description of Artificial Sequence: Synthetic peptide
  Seed: AQFTSQFLSLQCLQAL (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXL

SEQ ID NO: 349112 - protein, 16 aa, Artificial Sequence
  Description of Artificial Sequence: Synthetic peptide
  Seed: AQFTSQFLSLQCLQAL (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAX

SEQ ID NO: 349113 - protein, 17 aa, Artificial Sequence
  Description of Artificial Sequence: Synthetic peptide
  Seed: AQFTSQFLSLQCLQALY (PRAME_HUMAN)
  Core: QFTSQFLSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXFTXQXLSXQCLQALY

SEQ ID NO: 349114 - protein, 17 aa, Artificial Sequence
  Description of Artificial Sequence: Synthetic peptide
  Seed: AQFTSQFLSLQCLQALY (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQALY

SEQ ID NO: 349115 - protein, 17 aa, Artificial Sequence
  Description of Artificial Sequence: Synthetic peptide
  Seed: AQFTSQFLSLQCLQALY (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLY

SEQ ID NO: 349116 - protein, 17 aa, Artificial Sequence
  Description of Artificial Sequence: Synthetic peptide
  Seed: AQFTSQFLSLQCLQALY (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXY

SEQ ID NO: 349117 - protein, 18 aa, Artificial Sequence
  Description of Artificial Sequence: Synthetic peptide
  Seed: AQFTSQFLSLQCLQALYV (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQALYV

SEQ ID NO: 349118 - protein, 18 aa, Artificial Sequence
  Description of Artificial Sequence: Synthetic peptide
  Seed: AQFTSQFLSLQCLQALYV (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYV

SEQ ID NO: 349119 - protein, 18 aa, Artificial Sequence
  Description of Artificial Sequence: Synthetic peptide
  Seed: AQFTSQFLSLQCLQALYV (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYV

SEQ ID NO: 349120 - protein, 19 aa, Artificial Sequence
  Description of Artificial Sequence: Synthetic peptide
  Seed: AQFTSQFLSLQCLQALYVD (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQALYVD

SEQ ID NO: 349121 - protein, 19 aa, Artificial Sequence
  Description of Artificial Sequence: Synthetic peptide
  Seed: AQFTSQFLSLQCLQALYVD (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVD

SEQ ID NO: 349122 - protein, 19 aa, Artificial Sequence
  Description of Artificial Sequence: Synthetic peptide
  Seed: AQFTSQFLSLQCLQALYVD (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVD

SEQ ID NO: 349123 - protein, 19 aa, Artificial Sequence
  Description of Artificial Sequence: Synthetic peptide
  Seed: AQFTSQFLSLQCLQALYVD (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXD

SEQ ID NO: 349124 - protein, 20 aa, Artificial Sequence
  Description of Artificial Sequence: Synthetic peptide
  Seed: AQFTSQFLSLQCLQALYVDS (PRAME_HUMAN)
  Core: TSQFLSLQC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQFXSQXLXLQXLQALYVDS

SEQ ID NO: 349125 - protein, 20 aa, Artificial Sequence
  Description of Artificial Sequence: Synthetic peptide
  Seed: AQFTSQFLSLQCLQALYVDS (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDS

SEQ ID NO: 349126 - protein, 20 aa, Artificial Sequence
  Description of Artificial Sequence: Synthetic peptide
  Seed: AQFTSQFLSLQCLQALYVDS (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDS

SEQ ID NO: 349127 - protein, 20 aa, Artificial Sequence
  Description of Artificial Sequence: Synthetic peptide
  Seed: AQFTSQFLSLQCLQALYVDS (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDS

SEQ ID NO: 349128 - protein, 21 aa, Artificial Sequence
  Description of Artificial Sequence: Synthetic peptide
  Seed: AQFTSQFLSLQCLQALYVDSL (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDSL

SEQ ID NO: 349129 - protein, 21 aa, Artificial Sequence
  Description of Artificial Sequence: Synthetic peptide
  Seed: AQFTSQFLSLQCLQALYVDSL (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDSL

SEQ ID NO: 349130 - protein, 21 aa, Artificial Sequence
  Description of Artificial Sequence: Synthetic peptide
  Seed: AQFTSQFLSLQCLQALYVDSL (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDSL

SEQ ID NO: 349131 - protein, 22 aa, Artificial Sequence
  Description of Artificial Sequence: Synthetic peptide
  Seed: AQFTSQFLSLQCLQALYVDSLF (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDSLF

SEQ ID NO: 349132 - protein, 22 aa, Artificial Sequence
  Description of Artificial Sequence: Synthetic peptide
  Seed: AQFTSQFLSLQCLQALYVDSLF (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDSLF

SEQ ID NO: 349133 - protein, 22 aa, Artificial Sequence
  Description of Artificial Sequence: Synthetic peptide
  Seed: AQFTSQFLSLQCLQALYVDSLF (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDSLF

SEQ ID NO: 349134 - protein, 23 aa, Artificial Sequence
  Description of Artificial Sequence: Synthetic peptide
  Seed: AQFTSQFLSLQCLQALYVDSLFF (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDSLFF

SEQ ID NO: 349135 - protein, 23 aa, Artificial Sequence
  Description of Artificial Sequence: Synthetic peptide
  Seed: AQFTSQFLSLQCLQALYVDSLFF (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDSLFF

SEQ ID NO: 349136 - protein, 23 aa, Artificial Sequence
  Description of Artificial Sequence: Synthetic peptide
  Seed: AQFTSQFLSLQCLQALYVDSLFF (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDSLFF

SEQ ID NO: 349137 - protein, 24 aa, Artificial Sequence
  Description of Artificial Sequence: Synthetic peptide
  Seed: AQFTSQFLSLQCLQALYVDSLFFL (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDSLFFL

SEQ ID NO: 349138 - protein, 24 aa, Artificial Sequence
  Description of Artificial Sequence: Synthetic peptide
  Seed: AQFTSQFLSLQCLQALYVDSLFFL (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDSLFFL

SEQ ID NO: 349139 - protein, 24 aa, Artificial Sequence
  Description of Artificial Sequence: Synthetic peptide
  Seed: AQFTSQFLSLQCLQALYVDSLFFL (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDSLFFL

SEQ ID NO: 349140 - protein, 25 aa, Artificial Sequence
  Description of Artificial Sequence: Synthetic peptide
  Seed: AQFTSQFLSLQCLQALYVDSLFFLR (PRAME_HUMAN)
  Core: FLSLQCLQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQXLSXQXLQXLYVDSLFFLR

SEQ ID NO: 349141 - protein, 25 aa, Artificial Sequence
  Description of Artificial Sequence: Synthetic peptide
  Seed: AQFTSQFLSLQCLQALYVDSLFFLR (PRAME_HUMAN)
  Core: LSLQCLQAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFXSLXCXQAXYVDSLFFLR

SEQ ID NO: 349142 - protein, 25 aa, Artificial Sequence
  Description of Artificial Sequence: Synthetic peptide
  Seed: AQFTSQFLSLQCLQALYVDSLFFLR (PRAME_HUMAN)
  Core: LQCLQALYV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSXQCXQXLYXDSLFFLR

SEQ ID NO: 349143 - protein, 25 aa, Artificial Sequence
  Description of Artificial Sequence: Synthetic peptide
  Seed: AQFTSQFLSLQCLQALYVDSLFFLR (PRAME_HUMAN)
  Core: LQALYVDSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSLQCXQAXYXDSXFFLR

SEQ ID NO: 349144 - protein, 25 aa, Artificial Sequence
  Description of Artificial Sequence: Synthetic peptide
  Seed: AQFTSQFLSLQCLQALYVDSLFFLR (PRAME_HUMAN)
  Core: QALYVDSLF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSLQCLXALXVXSLXFLR

SEQ ID NO: 349145 - protein, 25 aa, Artificial Sequence
  Description of Artificial Sequence: Synthetic peptide
  Seed: AQFTSQFLSLQCLQALYVDSLFFLR (PRAME_HUMAN)
  Core: LYVDSLFFL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSLQCLQAXYVXSXFFXR

SEQ ID NO: 349146 - protein, 25 aa, Artificial Sequence
  Description of Artificial Sequence: Synthetic peptide
  Seed: AQFTSQFLSLQCLQALYVDSLFFLR (PRAME_HUMAN)
  Core: YVDSLFFLR
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
AQFTSQFLSLQCLQALXVDXLXFLX

SEQ ID NO: 349147 - protein, 15 aa, Artificial Sequence
  Description of Artificial Sequence: Synthetic peptide
  Seed: AQPMTKKRKVDGLST (PRAME_HUMAN)
  Core: MTKKRKVDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQPXTKXRXVDXLST

SEQ ID NO: 349148 - protein, 20 aa, Artificial Sequence
  Description of Artificial Sequence: Synthetic peptide
  Seed: AQPMTKKRKVDGLSTEAEQP (PRAME_HUMAN)
  Core: RKVDGLSTE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKXKVXGXSTXAEQP

SEQ ID NO: 349149 - protein, 21 aa, Artificial Sequence
  Description of Artificial Sequence: Synthetic peptide
  Seed: AQPMTKKRKVDGLSTEAEQPF (PRAME_HUMAN)
  Core: LSTEAEQPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKRKVDGXSTXAXQPX

SEQ ID NO: 349150 - protein, 22 aa, Artificial Sequence
  Description of Artificial Sequence: Synthetic peptide
  Seed: AQPMTKKRKVDGLSTEAEQPFI (PRAME_HUMAN)
  Core: LSTEAEQPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKRKVDGXSTXAXQPXI

SEQ ID NO: 349151 - protein, 23 aa, Artificial Sequence
  Description of Artificial Sequence: Synthetic peptide
  Seed: AQPMTKKRKVDGLSTEAEQPFIP (PRAME_HUMAN)
  Core: LSTEAEQPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKRKVDGXSTXAXQPXIP

SEQ ID NO: 349152 - protein, 24 aa, Artificial Sequence
  Description of Artificial Sequence: Synthetic peptide
  Seed: AQPMTKKRKVDGLSTEAEQPFIPV (PRAME_HUMAN)
  Core: RKVDGLSTE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKXKVXGXSTXAEQPFIPV

SEQ ID NO: 349153 - protein, 24 aa, Artificial Sequence
  Description of Artificial Sequence: Synthetic peptide
  Seed: AQPMTKKRKVDGLSTEAEQPFIPV (PRAME_HUMAN)
  Core: LSTEAEQPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKRKVDGXSTXAXQPXIPV

SEQ ID NO: 349154 - protein, 25 aa, Artificial Sequence
  Description of Artificial Sequence: Synthetic peptide
  Seed: AQPMTKKRKVDGLSTEAEQPFIPVE (PRAME_HUMAN)
  Core: RKVDGLSTE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKXKVXGXSTXAEQPFIPVE

SEQ ID NO: 349155 - protein, 25 aa, Artificial Sequence
  Description of Artificial Sequence: Synthetic peptide
  Seed: AQPMTKKRKVDGLSTEAEQPFIPVE (PRAME_HUMAN)
  Core: LSTEAEQPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQPMTKKRKVDGXSTXAXQPXIPVE

SEQ ID NO: 349156 - protein, 14 aa, Artificial Sequence
  Description of Artificial Sequence: Synthetic peptide
  Seed: ARLRELLCELGRPS (PRAME_HUMAN)
  Core: RLRELLCEL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLRXLXCEXGRPS

SEQ ID NO: 349157 - protein, 14 aa, Artificial Sequence
  Description of Artificial Sequence: Synthetic peptide
  Seed: ARLRELLCELGRPS (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPS

SEQ ID NO: 349158 - protein, 15 aa, Artificial Sequence
  Description of Artificial Sequence: Synthetic peptide
  Seed: ARLRELLCELGRPSM (PRAME_HUMAN)
  Core: RLRELLCEL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLRXLXCEXGRPSM

SEQ ID NO: 349159 - protein, 15 aa, Artificial Sequence
  Description of Artificial Sequence: Synthetic peptide
  Seed: ARLRELLCELGRPSM (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSM

SEQ ID NO: 349160 - protein, 15 aa, Artificial Sequence
  Description of Artificial Sequence: Synthetic peptide
  Seed: ARLRELLCELGRPSM (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXM

SEQ ID NO: 349161 - protein, 16 aa, Artificial Sequence
  Description of Artificial Sequence: Synthetic peptide
  Seed: ARLRELLCELGRPSMV (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMV

SEQ ID NO: 349162 - protein, 16 aa, Artificial Sequence
  Description of Artificial Sequence: Synthetic peptide
  Seed: ARLRELLCELGRPSMV (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMV

SEQ ID NO: 349163 - protein, 17 aa, Artificial Sequence
  Description of Artificial Sequence: Synthetic peptide
  Seed: ARLRELLCELGRPSMVW (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVW

SEQ ID NO: 349164 - protein, 17 aa, Artificial Sequence
  Description of Artificial Sequence: Synthetic peptide
  Seed: ARLRELLCELGRPSMVW (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVW

SEQ ID NO: 349165 - protein, 17 aa, Artificial Sequence
  Description of Artificial Sequence: Synthetic peptide
  Seed: ARLRELLCELGRPSMVW (PRAME_HUMAN)
  Core: LCELGRPSM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELXCEXGXPSXVW

SEQ ID NO: 349166 - protein, 18 aa, Artificial Sequence
  Description of Artificial Sequence: Synthetic peptide
  Seed: ARLRELLCELGRPSMVWL (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWL

SEQ ID NO: 349167 - protein, 18 aa, Artificial Sequence
  Description of Artificial Sequence: Synthetic peptide
  Seed: ARLRELLCELGRPSMVWL (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWL

SEQ ID NO: 349168 - protein, 19 aa, Artificial Sequence
  Description of Artificial Sequence: Synthetic peptide
  Seed: ARLRELLCELGRPSMVWLS (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWLS

SEQ ID NO: 349169 - protein, 19 aa, Artificial Sequence
  Description of Artificial Sequence: Synthetic peptide
  Seed: ARLRELLCELGRPSMVWLS (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWLS

SEQ ID NO: 349170 - protein, 19 aa, Artificial Sequence
  Description of Artificial Sequence: Synthetic peptide
  Seed: ARLRELLCELGRPSMVWLS (PRAME_HUMAN)
  Core: CELGRPSMV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLXELXRXSMXWLS

SEQ ID NO: 349171 - protein, 19 aa, Artificial Sequence
  Description of Artificial Sequence: Synthetic peptide
  Seed: ARLRELLCELGRPSMVWLS (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLX

SEQ ID NO: 349172 - protein, 20 aa, Artificial Sequence
  Description of Artificial Sequence: Synthetic peptide
  Seed: ARLRELLCELGRPSMVWLSA (PRAME_HUMAN)
  Core: RLRELLCEL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLRXLXCEXGRPSMVWLSA

SEQ ID NO: 349173 - protein, 20 aa, Artificial Sequence
  Description of Artificial Sequence: Synthetic peptide
  Seed: ARLRELLCELGRPSMVWLSA (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWLSA

SEQ ID NO: 349174 - protein, 20 aa, Artificial Sequence
  Description of Artificial Sequence: Synthetic peptide
  Seed: ARLRELLCELGRPSMVWLSA (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWLSA

SEQ ID NO: 349175 - protein, 20 aa, Artificial Sequence
  Description of Artificial Sequence: Synthetic peptide
  Seed: ARLRELLCELGRPSMVWLSA (PRAME_HUMAN)
  Core: LCELGRPSM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELXCEXGXPSXVWLSA

SEQ ID NO: 349176 - protein, 20 aa, Artificial Sequence
  Description of Artificial Sequence: Synthetic peptide
  Seed: ARLRELLCELGRPSMVWLSA (PRAME_HUMAN)
  Core: CELGRPSMV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLXELXRXSMXWLSA

SEQ ID NO: 349177 - protein, 20 aa, Artificial Sequence
  Description of Artificial Sequence: Synthetic peptide
  Seed: ARLRELLCELGRPSMVWLSA (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXA

SEQ ID NO: 349178 - protein, 21 aa, Artificial Sequence
  Description of Artificial Sequence: Synthetic peptide
  Seed: ARLRELLCELGRPSMVWLSAN (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWLSAN

SEQ ID NO: 349179 - protein, 21 aa, Artificial Sequence
  Description of Artificial Sequence: Synthetic peptide
  Seed: ARLRELLCELGRPSMVWLSAN (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWLSAN

SEQ ID NO: 349180 - protein, 21 aa, Artificial Sequence
  Description of Artificial Sequence: Synthetic peptide
  Seed: ARLRELLCELGRPSMVWLSAN (PRAME_HUMAN)
  Core: LCELGRPSM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELXCEXGXPSXVWLSAN

SEQ ID NO: 349181 - protein, 21 aa, Artificial Sequence
  Description of Artificial Sequence: Synthetic peptide
  Seed: ARLRELLCELGRPSMVWLSAN (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXAN

SEQ ID NO: 349182 - protein, 22 aa, Artificial Sequence
  Description of Artificial Sequence: Synthetic peptide
  Seed: ARLRELLCELGRPSMVWLSANP (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWLSANP

SEQ ID NO: 349183 - protein, 22 aa, Artificial Sequence
  Description of Artificial Sequence: Synthetic peptide
  Seed: ARLRELLCELGRPSMVWLSANP (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWLSANP

SEQ ID NO: 349184 - protein, 22 aa, Artificial Sequence
  Description of Artificial Sequence: Synthetic peptide
  Seed: ARLRELLCELGRPSMVWLSANP (PRAME_HUMAN)
  Core: LCELGRPSM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELXCEXGXPSXVWLSANP

SEQ ID NO: 349185 - protein, 22 aa, Artificial Sequence
  Description of Artificial Sequence: Synthetic peptide
  Seed: ARLRELLCELGRPSMVWLSANP (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXANP

SEQ ID NO: 349186 - protein, 23 aa, Artificial Sequence
  Description of Artificial Sequence: Synthetic peptide
  Seed: ARLRELLCELGRPSMVWLSANPC (PRAME_HUMAN)
  Core: RLRELLCEL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLRXLXCEXGRPSMVWLSANPC

SEQ ID NO: 349187 - protein, 23 aa, Artificial Sequence
  Description of Artificial Sequence: Synthetic peptide
  Seed: ARLRELLCELGRPSMVWLSANPC (PRAME_HUMAN)
  Core: LRELLCELG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXREXLXELXRPSMVWLSANPC

SEQ ID NO: 349188 - protein, 23 aa, Artificial Sequence
  Description of Artificial Sequence: Synthetic peptide
  Seed: ARLRELLCELGRPSMVWLSANPC (PRAME_HUMAN)
  Core: LLCELGRPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARLREXLCXLXRPXMVWLSANPC

SEQ ID NO: 349189 - protein, 23 aa, Artificial Sequence
  Description of Artificial Sequence: Synthetic peptide
  Seed: ARLRELLCELGRPSMVWLSANPC (PRAME_HUMAN)
  Core: LCELGRPSM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELXCEXGXPSXVWLSANPC

SEQ ID NO: 349190 - protein, 23 aa, Artificial Sequence
  Description of Artificial Sequence: Synthetic peptide
  Seed: ARLRELLCELGRPSMVWLSANPC (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXANPC

SEQ ID NO: 349191 - protein, 23 aa, Artificial Sequence
  Description of Artificial Sequence: Synthetic peptide
  Seed: ARLRELLCELGRPSMVWLSANPC (PRAME_HUMAN)
  Core: MVWLSANPC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELGRPSXVWXSXNPX

SEQ ID NO: 349192 - protein, 24 aa, Artificial Sequence
  Description of Artificial Sequence: Synthetic peptide
  Seed: ARLRELLCELGRPSMVWLSANPCP (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXANPCP

SEQ ID NO: 349193 - protein, 24 aa, Artificial Sequence
  Description of Artificial Sequence: Synthetic peptide
  Seed: ARLRELLCELGRPSMVWLSANPCP (PRAME_HUMAN)
  Core: MVWLSANPC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELGRPSXVWXSXNPXP

SEQ ID NO: 349194 - protein, 25 aa, Artificial Sequence
  Description of Artificial Sequence: Synthetic peptide
  Seed: ARLRELLCELGRPSMVWLSANPCPH (PRAME_HUMAN)
  Core: GRPSMVWLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELXRPXMXWLXANPCPH

SEQ ID NO: 349195 - protein, 25 aa, Artificial Sequence
  Description of Artificial Sequence: Synthetic peptide
  Seed: ARLRELLCELGRPSMVWLSANPCPH (PRAME_HUMAN)
  Core: MVWLSANPC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ARLRELLCELGRPSXVWXSXNPXPH

SEQ ID NO: 349196 - protein, 15 aa, Artificial Sequence
  Description of Artificial Sequence: Synthetic peptide
  Seed: ASATLQDLVFDECGI (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGI

SEQ ID NO: 349197 - protein, 16 aa, Artificial Sequence
  Description of Artificial Sequence: Synthetic peptide
  Seed: ASATLQDLVFDECGIT (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGIT

SEQ ID NO: 349198 - protein, 17 aa, Artificial Sequence
  Description of Artificial Sequence: Synthetic peptide
  Seed: ASATLQDLVFDECGITD (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGITD

SEQ ID NO: 349199 - protein, 19 aa, Artificial Sequence
  Description of Artificial Sequence: Synthetic peptide
  Seed: ASATLQDLVFDECGITDDQ (PRAME_HUMAN)
  Core: LVFDECGIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDXVFXEXGIXDDQ

SEQ ID NO: 349200 - protein, 20 aa, Artificial Sequence
  Description of Artificial Sequence: Synthetic peptide
  Seed: ASATLQDLVFDECGITDDQL (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGITDDQL

SEQ ID NO: 349201 - protein, 20 aa, Artificial Sequence
  Description of Artificial Sequence: Synthetic peptide
  Seed: ASATLQDLVFDECGITDDQL (PRAME_HUMAN)
  Core: LVFDECGIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDXVFXEXGIXDDQL

SEQ ID NO: 349202 - protein, 23 aa, Artificial Sequence
  Description of Artificial Sequence: Synthetic peptide
  Seed: ASATLQDLVFDECGITDDQLLAL (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGITDDQLLAL

SEQ ID NO: 349203 - protein, 23 aa, Artificial Sequence
  Description of Artificial Sequence: Synthetic peptide
  Seed: ASATLQDLVFDECGITDDQLLAL (PRAME_HUMAN)
  Core: LVFDECGIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDXVFXEXGIXDDQLLAL

SEQ ID NO: 349204 - protein, 23 aa, Artificial Sequence
  Description of Artificial Sequence: Synthetic peptide
  Seed: ASATLQDLVFDECGITDDQLLAL (PRAME_HUMAN)
  Core: ECGITDDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDLVFDXCGXTXDQXLAL

SEQ ID NO: 349205 - protein, 24 aa, Artificial Sequence
  Description of Artificial Sequence: Synthetic peptide
  Seed: ASATLQDLVFDECGITDDQLLALL (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGITDDQLLALL

SEQ ID NO: 349206 - protein, 24 aa, Artificial Sequence
  Description of Artificial Sequence: Synthetic peptide
  Seed: ASATLQDLVFDECGITDDQLLALL (PRAME_HUMAN)
  Core: LVFDECGIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDXVFXEXGIXDDQLLALL

SEQ ID NO: 349207 - protein, 24 aa, Artificial Sequence
  Description of Artificial Sequence: Synthetic peptide
  Seed: ASATLQDLVFDECGITDDQLLALL (PRAME_HUMAN)
  Core: ECGITDDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDLVFDXCGXTXDQXLALL

SEQ ID NO: 349208 - protein, 25 aa, Artificial Sequence
  Description of Artificial Sequence: Synthetic peptide
  Seed: ASATLQDLVFDECGITDDQLLALLP (PRAME_HUMAN)
  Core: LQDLVFDEC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASATXQDXVXDEXGITDDQLLALLP

SEQ ID NO: 349209 - protein, 25 aa, Artificial Sequence
  Description of Artificial Sequence: Synthetic peptide
  Seed: ASATLQDLVFDECGITDDQLLALLP (PRAME_HUMAN)
  Core: ECGITDDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDLVFDXCGXTXDQXLALLP

SEQ ID NO: 349210 - protein, 25 aa, Artificial Sequence
  Description of Artificial Sequence: Synthetic peptide
  Seed: ASATLQDLVFDECGITDDQLLALLP (PRAME_HUMAN)
  Core: ITDDQLLAL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ASATLQDLVFDECGXTDXQXLAXLP

SEQ ID NO: 349211 - protein, 15 aa, Artificial Sequence
  Description of Artificial Sequence: Synthetic peptide
  Seed: ASLYSFPEPEAAQPM (PRAME_HUMAN)
  Core: LYSFPEPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXYSXPXPEXAQPM

SEQ ID NO: 349212 - protein, 17 aa, Artificial Sequence
  Description of Artificial Sequence: Synthetic peptide
  Seed: ASLYSFPEPEAAQPMTK (PRAME_HUMAN)
  Core: PEPEAAQPM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASLYSFXEPXAXQPXTK

SEQ ID NO: 349213 - protein, 19 aa, Artificial Sequence
  Description of Artificial Sequence: Synthetic peptide
  Seed: ASLYSFPEPEAAQPMTKKR (PRAME_HUMAN)
  Core: PEAAQPMTK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASLYSFPEXEAXQXMTXKR

SEQ ID NO: 349214 - protein, 20 aa, Artificial Sequence
  Description of Artificial Sequence: Synthetic peptide
  Seed: ASLYSFPEPEAAQPMTKKRK (PRAME_HUMAN)
  Core: LYSFPEPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXYSXPXPEXAQPMTKKRK

SEQ ID NO: 349215 - protein, 20 aa, Artificial Sequence
  Description of Artificial Sequence: Synthetic peptide
  Seed: ASLYSFPEPEAAQPMTKKRK (PRAME_HUMAN)
  Core: PEAAQPMTK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASLYSFPEXEAXQXMTXKRK

SEQ ID NO: 349216 - protein, 20 aa, Artificial Sequence
  Description of Artificial Sequence: Synthetic peptide
  Seed: ASSYISPEKEEQYIAQFTSQ (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQ

SEQ ID NO: 349217 - protein, 21 aa, Artificial Sequence
  Description of Artificial Sequence: Synthetic peptide
  Seed: ASSYISPEKEEQYIAQFTSQF (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQF

SEQ ID NO: 349218 - protein, 21 aa, Artificial Sequence
  Description of Artificial Sequence: Synthetic peptide
  Seed: ASSYISPEKEEQYIAQFTSQF (PRAME_HUMAN)
  Core: EEQYIAQFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKXEQXIXQFXSQF

SEQ ID NO: 349219 - protein, 21 aa, Artificial Sequence
  Description of Artificial Sequence: Synthetic peptide
  Seed: ASSYISPEKEEQYIAQFTSQF (PRAME_HUMAN)
  Core: EQYIAQFTS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEXQYXAXFTXQF

SEQ ID NO: 349220 - protein, 21 aa, Artificial Sequence
  Description of Artificial Sequence: Synthetic peptide
  Seed: ASSYISPEKEEQYIAQFTSQF (PRAME_HUMAN)
  Core: YIAQFTSQF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQXIAXFXSQX

SEQ ID NO: 349221 - protein, 22 aa, Artificial Sequence
  Description of Artificial Sequence: Synthetic peptide
  Seed: ASSYISPEKEEQYIAQFTSQFL (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQFL

SEQ ID NO: 349222 - protein, 22 aa, Artificial Sequence
  Description of Artificial Sequence: Synthetic peptide
  Seed: ASSYISPEKEEQYIAQFTSQFL (PRAME_HUMAN)
  Core: EKEEQYIAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPXKEXQXIAXFTSQFL

SEQ ID NO: 349223 - protein, 22 aa, Artificial Sequence
  Description of Artificial Sequence: Synthetic peptide
  Seed: ASSYISPEKEEQYIAQFTSQFL (PRAME_HUMAN)
  Core: KEEQYIAQF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEXEEXYXAQXTSQFL

SEQ ID NO: 349224 - protein, 22 aa, Artificial Sequence
  Description of Artificial Sequence: Synthetic peptide
  Seed: ASSYISPEKEEQYIAQFTSQFL (PRAME_HUMAN)
  Core: EEQYIAQFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKXEQXIXQFXSQFL

SEQ ID NO: 349225 - protein, 22 aa, Artificial Sequence
  Description of Artificial Sequence: Synthetic peptide
  Seed: ASSYISPEKEEQYIAQFTSQFL (PRAME_HUMAN)
  Core: QYIAQFTSQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEXYIXQXTSXFL

SEQ ID NO: 349226 - protein, 22 aa, Artificial Sequence
  Description of Artificial Sequence: Synthetic peptide
  Seed: ASSYISPEKEEQYIAQFTSQFL (PRAME_HUMAN)
  Core: YIAQFTSQF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQXIAXFXSQXL

SEQ ID NO: 349227 - protein, 23 aa, Artificial Sequence
  Description of Artificial Sequence: Synthetic peptide
  Seed: ASSYISPEKEEQYIAQFTSQFLS (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQFLS

SEQ ID NO: 349228 - protein, 23 aa, Artificial Sequence
  Description of Artificial Sequence: Synthetic peptide
  Seed: ASSYISPEKEEQYIAQFTSQFLS (PRAME_HUMAN)
  Core: KEEQYIAQF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEXEEXYXAQXTSQFLS

SEQ ID NO: 349229 - protein, 23 aa, Artificial Sequence
  Description of Artificial Sequence: Synthetic peptide
  Seed: ASSYISPEKEEQYIAQFTSQFLS (PRAME_HUMAN)
  Core: EEQYIAQFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKXEQXIXQFXSQFLS

SEQ ID NO: 349230 - protein, 23 aa, Artificial Sequence
  Description of Artificial Sequence: Synthetic peptide
  Seed: ASSYISPEKEEQYIAQFTSQFLS (PRAME_HUMAN)
  Core: QYIAQFTSQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEXYIXQXTSXFLS

SEQ ID NO: 349231 - protein, 23 aa, Artificial Sequence
  Description of Artificial Sequence: Synthetic peptide
  Seed: ASSYISPEKEEQYIAQFTSQFLS (PRAME_HUMAN)
  Core: YIAQFTSQF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQXIAXFXSQXLS

SEQ ID NO: 349232 - protein, 23 aa, Artificial Sequence
  Description of Artificial Sequence: Synthetic peptide
  Seed: ASSYISPEKEEQYIAQFTSQFLS (PRAME_HUMAN)
  Core: IAQFTSQFL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQYXAQXTXQFXS

SEQ ID NO: 349233 - protein, 24 aa, Artificial Sequence
  Description of Artificial Sequence: Synthetic peptide
  Seed: ASSYISPEKEEQYIAQFTSQFLSL (PRAME_HUMAN)
  Core: YISPEKEEQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXISXEXEEXYIAQFTSQFLSL

SEQ ID NO: 349234 - protein, 24 aa, Artificial Sequence
  Description of Artificial Sequence: Synthetic peptide
  Seed: ASSYISPEKEEQYIAQFTSQFLSL (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQFLSL

SEQ ID NO: 349235 - protein, 24 aa, Artificial Sequence
  Description of Artificial Sequence: Synthetic peptide
  Seed: ASSYISPEKEEQYIAQFTSQFLSL (PRAME_HUMAN)
  Core: EKEEQYIAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPXKEXQXIAXFTSQFLSL

SEQ ID NO: 349236 - protein, 24 aa, Artificial Sequence
  Description of Artificial Sequence: Synthetic peptide
  Seed: ASSYISPEKEEQYIAQFTSQFLSL (PRAME_HUMAN)
  Core: KEEQYIAQF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEXEEXYXAQXTSQFLSL

SEQ ID NO: 349237 - protein, 24 aa, Artificial Sequence
  Description of Artificial Sequence: Synthetic peptide
  Seed: ASSYISPEKEEQYIAQFTSQFLSL (PRAME_HUMAN)
  Core: EEQYIAQFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKXEQXIXQFXSQFLSL

SEQ ID NO: 349238 - protein, 24 aa, Artificial Sequence
  Description of Artificial Sequence: Synthetic peptide
  Seed: ASSYISPEKEEQYIAQFTSQFLSL (PRAME_HUMAN)
  Core: QYIAQFTSQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEXYIXQXTSXFLSL

SEQ ID NO: 349239 - protein, 24 aa, Artificial Sequence
  Description of Artificial Sequence: Synthetic peptide
  Seed: ASSYISPEKEEQYIAQFTSQFLSL (PRAME_HUMAN)
  Core: YIAQFTSQF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQXIAXFXSQXLSL

SEQ ID NO: 349240 - protein, 24 aa, Artificial Sequence
  Description of Artificial Sequence: Synthetic peptide
  Seed: ASSYISPEKEEQYIAQFTSQFLSL (PRAME_HUMAN)
  Core: IAQFTSQFL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQYXAQXTXQFXSL

SEQ ID NO: 349241 - protein, 25 aa, Artificial Sequence
  Description of Artificial Sequence: Synthetic peptide
  Seed: ASSYISPEKEEQYIAQFTSQFLSLQ (PRAME_HUMAN)
  Core: YISPEKEEQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXISXEXEEXYIAQFTSQFLSLQ

SEQ ID NO: 349242 - protein, 25 aa, Artificial Sequence
  Description of Artificial Sequence: Synthetic peptide
  Seed: ASSYISPEKEEQYIAQFTSQFLSLQ (PRAME_HUMAN)
  Core: ISPEKEEQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSYXSPXKXEQXIAQFTSQFLSLQ

SEQ ID NO: 349243 - protein, 25 aa, Artificial Sequence
  Description of Artificial Sequence: Synthetic peptide
  Seed: ASSYISPEKEEQYIAQFTSQFLSLQ (PRAME_HUMAN)
  Core: EKEEQYIAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPXKEXQXIAXFTSQFLSLQ

SEQ ID NO: 349244 - protein, 25 aa, Artificial Sequence
  Description of Artificial Sequence: Synthetic peptide
  Seed: ASSYISPEKEEQYIAQFTSQFLSLQ (PRAME_HUMAN)
  Core: KEEQYIAQF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEXEEXYXAQXTSQFLSLQ

SEQ ID NO: 349245 - protein, 25 aa, Artificial Sequence
  Description of Artificial Sequence: Synthetic peptide
  Seed: ASSYISPEKEEQYIAQFTSQFLSLQ (PRAME_HUMAN)
  Core: EEQYIAQFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKXEQXIXQFXSQFLSLQ

SEQ ID NO: 349246 - protein, 25 aa, Artificial Sequence
  Description of Artificial Sequence: Synthetic peptide
  Seed: ASSYISPEKEEQYIAQFTSQFLSLQ (PRAME_HUMAN)
  Core: QYIAQFTSQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEXYIXQXTSXFLSLQ

SEQ ID NO: 349247 - protein, 25 aa, Artificial Sequence
  Description of Artificial Sequence: Synthetic peptide
  Seed: ASSYISPEKEEQYIAQFTSQFLSLQ (PRAME_HUMAN)
  Core: YIAQFTSQF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQXIAXFXSQXLSLQ

SEQ ID NO: 349248 - protein, 25 aa, Artificial Sequence
  Description of Artificial Sequence: Synthetic peptide
  Seed: ASSYISPEKEEQYIAQFTSQFLSLQ (PRAME_HUMAN)
  Core: IAQFTSQFL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQYXAQXTXQFXSLQ

SEQ ID NO: 349249 - protein, 25 aa, Artificial Sequence
  Description of Artificial Sequence: Synthetic peptide
  Seed: ASSYISPEKEEQYIAQFTSQFLSLQ (PRAME_HUMAN)
  Core: QFTSQFLSL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
ASSYISPEKEEQYIAXFTXQXLSXQ

SEQ ID NO: 349250 - protein, 20 aa, Artificial Sequence
  Description of Artificial Sequence: Synthetic peptide
  Seed: ATLQDLVFDECGITDDQLLA (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLA

SEQ ID NO: 349251 - protein, 21 aa, Artificial Sequence
  Description of Artificial Sequence: Synthetic peptide
  Seed: ATLQDLVFDECGITDDQLLAL (PRAME_HUMAN)
  Core: LVFDECGIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDXVFXEXGIXDDQLLAL

SEQ ID NO: 349252 - protein, 21 aa, Artificial Sequence
  Description of Artificial Sequence: Synthetic peptide
  Seed: ATLQDLVFDECGITDDQLLAL (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLAL

SEQ ID NO: 349253 - protein, 22 aa, Artificial Sequence
  Description of Artificial Sequence: Synthetic peptide
  Seed: ATLQDLVFDECGITDDQLLALL (PRAME_HUMAN)
  Core: LVFDECGIT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDXVFXEXGIXDDQLLALL

SEQ ID NO: 349254 - protein, 22 aa, Artificial Sequence
  Description of Artificial Sequence: Synthetic peptide
  Seed: ATLQDLVFDECGITDDQLLALL (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLALL

SEQ ID NO: 349255 - protein, 22 aa, Artificial Sequence
  Description of Artificial Sequence: Synthetic peptide
  Seed: ATLQDLVFDECGITDDQLLALL (PRAME_HUMAN)
  Core: ITDDQLLAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDECGXTDXQXLAXL

SEQ ID NO: 349256 - protein, 23 aa, Artificial Sequence
  Description of Artificial Sequence: Synthetic peptide
  Seed: ATLQDLVFDECGITDDQLLALLP (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLALLP

SEQ ID NO: 349257 - protein, 23 aa, Artificial Sequence
  Description of Artificial Sequence: Synthetic peptide
  Seed: ATLQDLVFDECGITDDQLLALLP (PRAME_HUMAN)
  Core: ITDDQLLAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDECGXTDXQXLAXLP

SEQ ID NO: 349258 - protein, 24 aa, Artificial Sequence
  Description of Artificial Sequence: Synthetic peptide
  Seed: ATLQDLVFDECGITDDQLLALLPS (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLALLPS

SEQ ID NO: 349259 - protein, 24 aa, Artificial Sequence
  Description of Artificial Sequence: Synthetic peptide
  Seed: ATLQDLVFDECGITDDQLLALLPS (PRAME_HUMAN)
  Core: ITDDQLLAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDECGXTDXQXLAXLPS

SEQ ID NO: 349260 - protein, 25 aa, Artificial Sequence
  Description of Artificial Sequence: Synthetic peptide
  Seed: ATLQDLVFDECGITDDQLLALLPSL (PRAME_HUMAN)
  Core: ECGITDDQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDXCGXTXDQXLALLPSL

SEQ ID NO: 349261 - protein, 25 aa, Artificial Sequence
  Description of Artificial Sequence: Synthetic peptide
  Seed: ATLQDLVFDECGITDDQLLALLPSL (PRAME_HUMAN)
  Core: ITDDQLLAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ATLQDLVFDECGXTDXQXLAXLPSL

SEQ ID NO: 349262 - protein, 13 aa, Artificial Sequence
  Description of Artificial Sequence: Synthetic peptide
  Seed: AVLDGLDVLLAQE (PRAME_HUMAN)
  Core: LDGLDVLLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AVXDGXDXLLXQE

SEQ ID NO: 349263 - protein, 14 aa, Artificial Sequence
  Description of Artificial Sequence: Synthetic peptide
  Seed: AVLDGLDVLLAQEV (PRAME_HUMAN)
  Core: LDGLDVLLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AVXDGXDXLLXQEV

SEQ ID NO: 349264 - protein, 14 aa, Artificial Sequence
  Description of Artificial Sequence: Synthetic peptide
  Seed: AVLDGLDVLLAQEV (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEX

SEQ ID NO: 349265 - protein, 15 aa, Artificial Sequence
  Description of Artificial Sequence: Synthetic peptide
  Seed: AVLDGLDVLLAQEVR (PRAME_HUMAN)
  Core: LDGLDVLLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AVXDGXDXLLXQEVR

SEQ ID NO: 349266 - protein, 15 aa, Artificial Sequence
  Description of Artificial Sequence: Synthetic peptide
  Seed: AVLDGLDVLLAQEVR (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXR

SEQ ID NO: 349267 - protein, 16 aa, Artificial Sequence
  Description of Artificial Sequence: Synthetic peptide
  Seed: AVLDGLDVLLAQEVRP (PRAME_HUMAN)
  Core: LDGLDVLLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AVXDGXDXLLXQEVRP

SEQ ID NO: 349268 - protein, 16 aa, Artificial Sequence
  Description of Artificial Sequence: Synthetic peptide
  Seed: AVLDGLDVLLAQEVRP (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRP

SEQ ID NO: 349269 - protein, 17 aa, Artificial Sequence
  Description of Artificial Sequence: Synthetic peptide
  Seed: AVLDGLDVLLAQEVRPR (PRAME_HUMAN)
  Core: LDGLDVLLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AVXDGXDXLLXQEVRPR

SEQ ID NO: 349270 - protein, 17 aa, Artificial Sequence
  Description of Artificial Sequence: Synthetic peptide
  Seed: AVLDGLDVLLAQEVRPR (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPR

SEQ ID NO: 349271 - protein, 18 aa, Artificial Sequence
  Description of Artificial Sequence: Synthetic peptide
  Seed: AVLDGLDVLLAQEVRPRR (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRR

SEQ ID NO: 349272 - protein, 19 aa, Artificial Sequence
  Description of Artificial Sequence: Synthetic peptide
  Seed: AVLDGLDVLLAQEVRPRRW (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRW

SEQ ID NO: 349273 - protein, 19 aa, Artificial Sequence
  Description of Artificial Sequence: Synthetic peptide
  Seed: AVLDGLDVLLAQEVRPRRW (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRW

SEQ ID NO: 349274 - protein, 20 aa, Artificial Sequence
  Description of Artificial Sequence: Synthetic peptide
  Seed: AVLDGLDVLLAQEVRPRRWK (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWK

SEQ ID NO: 349275 - protein, 20 aa, Artificial Sequence
  Description of Artificial Sequence: Synthetic peptide
  Seed: AVLDGLDVLLAQEVRPRRWK (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWK

SEQ ID NO: 349276 - protein, 20 aa, Artificial Sequence
  Description of Artificial Sequence: Synthetic peptide
  Seed: AVLDGLDVLLAQEVRPRRWK (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWK

SEQ ID NO: 349277 - protein, 21 aa, Artificial Sequence
  Description of Artificial Sequence: Synthetic peptide
  Seed: AVLDGLDVLLAQEVRPRRWKL (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWKL

SEQ ID NO: 349278 - protein, 21 aa, Artificial Sequence
  Description of Artificial Sequence: Synthetic peptide
  Seed: AVLDGLDVLLAQEVRPRRWKL (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWKL

SEQ ID NO: 349279 - protein, 21 aa, Artificial Sequence
  Description of Artificial Sequence: Synthetic peptide
  Seed: AVLDGLDVLLAQEVRPRRWKL (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWKL

SEQ ID NO: 349280 - protein, 22 aa, Artificial Sequence
  Description of Artificial Sequence: Synthetic peptide
  Seed: AVLDGLDVLLAQEVRPRRWKLQ (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWKLQ

SEQ ID NO: 349281 - protein, 22 aa, Artificial Sequence
  Description of Artificial Sequence: Synthetic peptide
  Seed: AVLDGLDVLLAQEVRPRRWKLQ (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWKLQ

SEQ ID NO: 349282 - protein, 22 aa, Artificial Sequence
  Description of Artificial Sequence: Synthetic peptide
  Seed: AVLDGLDVLLAQEVRPRRWKLQ (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWKLQ

SEQ ID NO: 349283 - protein, 23 aa, Artificial Sequence
  Description of Artificial Sequence: Synthetic peptide
  Seed: AVLDGLDVLLAQEVRPRRWKLQV (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWKLQV

SEQ ID NO: 349284 - protein, 23 aa, Artificial Sequence
  Description of Artificial Sequence: Synthetic peptide
  Seed: AVLDGLDVLLAQEVRPRRWKLQV (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWKLQV

SEQ ID NO: 349285 - protein, 23 aa, Artificial Sequence
  Description of Artificial Sequence: Synthetic peptide
  Seed: AVLDGLDVLLAQEVRPRRWKLQV (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWKLQV

SEQ ID NO: 349286 - protein, 24 aa, Artificial Sequence
  Description of Artificial Sequence: Synthetic peptide
  Seed: AVLDGLDVLLAQEVRPRRWKLQVL (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWKLQVL

SEQ ID NO: 349287 - protein, 24 aa, Artificial Sequence
  Description of Artificial Sequence: Synthetic peptide
  Seed: AVLDGLDVLLAQEVRPRRWKLQVL (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWKLQVL

SEQ ID NO: 349288 - protein, 24 aa, Artificial Sequence
  Description of Artificial Sequence: Synthetic peptide
  Seed: AVLDGLDVLLAQEVRPRRWKLQVL (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWKLQVL

SEQ ID NO: 349289 - protein, 24 aa, Artificial Sequence
  Description of Artificial Sequence: Synthetic peptide
  Seed: AVLDGLDVLLAQEVRPRRWKLQVL (PRAME_HUMAN)
  Core: VRPRRWKLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLLAQEXRPXRXKLXVL

SEQ ID NO: 349290 - protein, 25 aa, Artificial Sequence
  Description of Artificial Sequence: Synthetic peptide
  Seed: AVLDGLDVLLAQEVRPRRWKLQVLD (PRAME_HUMAN)
  Core: LDVLLAQEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGXDVXLXQEXRPRRWKLQVLD

SEQ ID NO: 349291 - protein, 25 aa, Artificial Sequence
  Description of Artificial Sequence: Synthetic peptide
  Seed: AVLDGLDVLLAQEVRPRRWKLQVLD (PRAME_HUMAN)
  Core: LLAQEVRPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVXLAXEXRPXRWKLQVLD

SEQ ID NO: 349292 - protein, 25 aa, Artificial Sequence
  Description of Artificial Sequence: Synthetic peptide
  Seed: AVLDGLDVLLAQEVRPRRWKLQVLD (PRAME_HUMAN)
  Core: LAQEVRPRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLXAQXVXPRXWKLQVLD

SEQ ID NO: 349293 - protein, 25 aa, Artificial Sequence
  Description of Artificial Sequence: Synthetic peptide
  Seed: AVLDGLDVLLAQEVRPRRWKLQVLD (PRAME_HUMAN)
  Core: VRPRRWKLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLLAQEXRPXRXKLXVLD

SEQ ID NO: 349294 - protein, 25 aa, Artificial Sequence
  Description of Artificial Sequence: Synthetic peptide
  Seed: AVLDGLDVLLAQEVRPRRWKLQVLD (PRAME_HUMAN)
  Core: PRRWKLQVL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLLAQEVRXRRXKXQVXD

SEQ ID NO: 349295 - protein, 25 aa, Artificial Sequence
  Description of Artificial Sequence: Synthetic peptide
  Seed: AVLDGLDVLLAQEVRPRRWKLQVLD (PRAME_HUMAN)
  Core: RRWKLQVLD
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
AVLDGLDVLLAQEVRPXRWXLXVLX

SEQ ID NO: 349296 - protein, 13 aa, Artificial Sequence
  Description of Artificial Sequence: Synthetic peptide
  Seed: AWPFTCLPLGVLM (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXM

SEQ ID NO: 349297 - protein, 14 aa, Artificial Sequence
  Description of Artificial Sequence: Synthetic peptide
  Seed: AWPFTCLPLGVLMK (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMK

SEQ ID NO: 349298 - protein, 15 aa, Artificial Sequence
  Description of Artificial Sequence: Synthetic peptide
  Seed: AWPFTCLPLGVLMKG (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKG

SEQ ID NO: 349299 - protein, 15 aa, Artificial Sequence
  Description of Artificial Sequence: Synthetic peptide
  Seed: AWPFTCLPLGVLMKG (PRAME_HUMAN)
  Core: CLPLGVLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTXLPXGXLMXG

SEQ ID NO: 349300 - protein, 16 aa, Artificial Sequence
  Description of Artificial Sequence: Synthetic peptide
  Seed: AWPFTCLPLGVLMKGQ (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQ

SEQ ID NO: 349301 - protein, 17 aa, Artificial Sequence
  Description of Artificial Sequence: Synthetic peptide
  Seed: AWPFTCLPLGVLMKGQH (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQH

SEQ ID NO: 349302 - protein, 17 aa, Artificial Sequence
  Description of Artificial Sequence: Synthetic peptide
  Seed: AWPFTCLPLGVLMKGQH (PRAME_HUMAN)
  Core: CLPLGVLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTXLPXGXLMXGQH

SEQ ID NO: 349303 - protein, 17 aa, Artificial Sequence
  Description of Artificial Sequence: Synthetic peptide
  Seed: AWPFTCLPLGVLMKGQH (PRAME_HUMAN)
  Core: LGVLMKGQH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPXGVXMXGQX

SEQ ID NO: 349304 - protein, 18 aa, Artificial Sequence
  Description of Artificial Sequence: Synthetic peptide
  Seed: AWPFTCLPLGVLMKGQHL (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHL

SEQ ID NO: 349305 - protein, 19 aa, Artificial Sequence
  Description of Artificial Sequence: Synthetic peptide
  Seed: AWPFTCLPLGVLMKGQHLH (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHLH

SEQ ID NO: 349306 - protein, 19 aa, Artificial Sequence
  Description of Artificial Sequence: Synthetic peptide
  Seed: AWPFTCLPLGVLMKGQHLH (PRAME_HUMAN)
  Core: LGVLMKGQH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPXGVXMXGQXLH

SEQ ID NO: 349307 - protein, 19 aa, Artificial Sequence
  Description of Artificial Sequence: Synthetic peptide
  Seed: AWPFTCLPLGVLMKGQHLH (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXH

SEQ ID NO: 349308 - protein, 19 aa, Artificial Sequence
  Description of Artificial Sequence: Synthetic peptide
  Seed: AWPFTCLPLGVLMKGQHLH (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLX

SEQ ID NO: 349309 - protein, 20 aa, Artificial Sequence
  Description of Artificial Sequence: Synthetic peptide
  Seed: AWPFTCLPLGVLMKGQHLHL (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHLHL

SEQ ID NO: 349310 - protein, 20 aa, Artificial Sequence
  Description of Artificial Sequence: Synthetic peptide
  Seed: AWPFTCLPLGVLMKGQHLHL (PRAME_HUMAN)
  Core: LGVLMKGQH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPXGVXMXGQXLHL

SEQ ID NO: 349311 - protein, 20 aa, Artificial Sequence
  Description of Artificial Sequence: Synthetic peptide
  Seed: AWPFTCLPLGVLMKGQHLHL (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHL

SEQ ID NO: 349312 - protein, 20 aa, Artificial Sequence
  Description of Artificial Sequence: Synthetic peptide
  Seed: AWPFTCLPLGVLMKGQHLHL (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXL

SEQ ID NO: 349313 - protein, 21 aa, Artificial Sequence
  Description of Artificial Sequence: Synthetic peptide
  Seed: AWPFTCLPLGVLMKGQHLHLE (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHLHLE

SEQ ID NO: 349314 - protein, 21 aa, Artificial Sequence
  Description of Artificial Sequence: Synthetic peptide
  Seed: AWPFTCLPLGVLMKGQHLHLE (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHLE

SEQ ID NO: 349315 - protein, 21 aa, Artificial Sequence
  Description of Artificial Sequence: Synthetic peptide
  Seed: AWPFTCLPLGVLMKGQHLHLE (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXLE

SEQ ID NO: 349316 - protein, 21 aa, Artificial Sequence
  Description of Artificial Sequence: Synthetic peptide
  Seed: AWPFTCLPLGVLMKGQHLHLE (PRAME_HUMAN)
  Core: MKGQHLHLE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGVLXKGXHXHLX

SEQ ID NO: 349317 - protein, 22 aa, Artificial Sequence
  Description of Artificial Sequence: Synthetic peptide
  Seed: AWPFTCLPLGVLMKGQHLHLET (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHLHLET

SEQ ID NO: 349318 - protein, 22 aa, Artificial Sequence
  Description of Artificial Sequence: Synthetic peptide
  Seed: AWPFTCLPLGVLMKGQHLHLET (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHLET

SEQ ID NO: 349319 - protein, 22 aa, Artificial Sequence
  Description of Artificial Sequence: Synthetic peptide
  Seed: AWPFTCLPLGVLMKGQHLHLET (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXLET

SEQ ID NO: 349320 - protein, 22 aa, Artificial Sequence
  Description of Artificial Sequence: Synthetic peptide
  Seed: AWPFTCLPLGVLMKGQHLHLET (PRAME_HUMAN)
  Core: MKGQHLHLE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGVLXKGXHXHLXT

SEQ ID NO: 349321 - protein, 23 aa, Artificial Sequence
  Description of Artificial Sequence: Synthetic peptide
  Seed: AWPFTCLPLGVLMKGQHLHLETF (PRAME_HUMAN)
  Core: FTCLPLGVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AWPXTCXPXGVXMKGQHLHLETF

SEQ ID NO: 349322 - protein, 23 aa, Artificial Sequence
  Description of Artificial Sequence: Synthetic peptide
  Seed: AWPFTCLPLGVLMKGQHLHLETF (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHLETF

SEQ ID NO: 349323 - protein, 23 aa, Artificial Sequence
  Description of Artificial Sequence: Synthetic peptide
  Seed: AWPFTCLPLGVLMKGQHLHLETF (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXLETF

SEQ ID NO: 349324 - protein, 23 aa, Artificial Sequence
  Description of Artificial Sequence: Synthetic peptide
  Seed: AWPFTCLPLGVLMKGQHLHLETF (PRAME_HUMAN)
  Core: MKGQHLHLE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGVLXKGXHXHLXTF

SEQ ID NO: 349325 - protein, 24 aa, Artificial Sequence
  Description of Artificial Sequence: Synthetic peptide
  Seed: AWPFTCLPLGVLMKGQHLHLETFK (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHLETFK

SEQ ID NO: 349326 - protein, 24 aa, Artificial Sequence
  Description of Artificial Sequence: Synthetic peptide
  Seed: AWPFTCLPLGVLMKGQHLHLETFK (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXLETFK

SEQ ID NO: 349327 - protein, 24 aa, Artificial Sequence
  Description of Artificial Sequence: Synthetic peptide
  Seed: AWPFTCLPLGVLMKGQHLHLETFK (PRAME_HUMAN)
  Core: MKGQHLHLE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGVLXKGXHXHLXTFK

SEQ ID NO: 349328 - protein, 25 aa, Artificial Sequence
  Description of Artificial Sequence: Synthetic peptide
  Seed: AWPFTCLPLGVLMKGQHLHLETFKA (PRAME_HUMAN)
  Core: GVLMKGQHL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLXVLXKXQHXHLETFKA

SEQ ID NO: 349329 - protein, 25 aa, Artificial Sequence
  Description of Artificial Sequence: Synthetic peptide
  Seed: AWPFTCLPLGVLMKGQHLHLETFKA (PRAME_HUMAN)
  Core: VLMKGQHLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGXLMXGXHLXLETFKA

SEQ ID NO: 349330 - protein, 25 aa, Artificial Sequence
  Description of Artificial Sequence: Synthetic peptide
  Seed: AWPFTCLPLGVLMKGQHLHLETFKA (PRAME_HUMAN)
  Core: MKGQHLHLE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AWPFTCLPLGVLXKGXHXHLXTFKA

SEQ ID NO: 349331 - protein, 13 aa, Artificial Sequence
  Description of Artificial Sequence: Synthetic peptide
  Seed: AYLHARLRELLCE (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCE

SEQ ID NO: 349332 - protein, 13 aa, Artificial Sequence
  Description of Artificial Sequence: Synthetic peptide
  Seed: AYLHARLRELLCE (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCE

SEQ ID NO: 349333 - protein, 14 aa, Artificial Sequence
  Description of Artificial Sequence: Synthetic peptide
  Seed: AYLHARLRELLCEL (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCEL

SEQ ID NO: 349334 - protein, 14 aa, Artificial Sequence
  Description of Artificial Sequence: Synthetic peptide
  Seed: AYLHARLRELLCEL (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCEL

SEQ ID NO: 349335 - protein, 15 aa, Artificial Sequence
  Description of Artificial Sequence: Synthetic peptide
  Seed: AYLHARLRELLCELG (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELG

SEQ ID NO: 349336 - protein, 15 aa, Artificial Sequence
  Description of Artificial Sequence: Synthetic peptide
  Seed: AYLHARLRELLCELG (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCELG

SEQ ID NO: 349337 - protein, 15 aa, Artificial Sequence
  Description of Artificial Sequence: Synthetic peptide
  Seed: AYLHARLRELLCELG (PRAME_HUMAN)
  Core: HARLRELLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AYLXARXRXLLXELG

SEQ ID NO: 349338 - protein, 15 aa, Artificial Sequence
  Description of Artificial Sequence: Synthetic peptide
  Seed: AYLHARLRELLCELG (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXG

SEQ ID NO: 349339 - protein, 15 aa, Artificial Sequence
  Description of Artificial Sequence: Synthetic peptide
  Seed: AYLHARLRELLCELG (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELX

SEQ ID NO: 349340 - protein, 16 aa, Artificial Sequence
  Description of Artificial Sequence: Synthetic peptide
  Seed: AYLHARLRELLCELGR (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELGR

SEQ ID NO: 349341 - protein, 16 aa, Artificial Sequence
  Description of Artificial Sequence: Synthetic peptide
  Seed: AYLHARLRELLCELGR (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCELGR

SEQ ID NO: 349342 - protein, 16 aa, Artificial Sequence
  Description of Artificial Sequence: Synthetic peptide
  Seed: AYLHARLRELLCELGR (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGR

SEQ ID NO: 349343 - protein, 16 aa, Artificial Sequence
  Description of Artificial Sequence: Synthetic peptide
  Seed: AYLHARLRELLCELGR (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXR

SEQ ID NO: 349344 - protein, 17 aa, Artificial Sequence
  Description of Artificial Sequence: Synthetic peptide
  Seed: AYLHARLRELLCELGRP (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELGRP

SEQ ID NO: 349345 - protein, 17 aa, Artificial Sequence
  Description of Artificial Sequence: Synthetic peptide
  Seed: AYLHARLRELLCELGRP (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCELGRP

SEQ ID NO: 349346 - protein, 17 aa, Artificial Sequence
  Description of Artificial Sequence: Synthetic peptide
  Seed: AYLHARLRELLCELGRP (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRP

SEQ ID NO: 349347 - protein, 17 aa, Artificial Sequence
  Description of Artificial Sequence: Synthetic peptide
  Seed: AYLHARLRELLCELGRP (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRP

SEQ ID NO: 349348 - protein, 18 aa, Artificial Sequence
  Description of Artificial Sequence: Synthetic peptide
  Seed: AYLHARLRELLCELGRPS (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELGRPS

SEQ ID NO: 349349 - protein, 18 aa, Artificial Sequence
  Description of Artificial Sequence: Synthetic peptide
  Seed: AYLHARLRELLCELGRPS (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPS

SEQ ID NO: 349350 - protein, 18 aa, Artificial Sequence
  Description of Artificial Sequence: Synthetic peptide
  Seed: AYLHARLRELLCELGRPS (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPS

SEQ ID NO: 349351 - protein, 19 aa, Artificial Sequence
  Description of Artificial Sequence: Synthetic peptide
  Seed: AYLHARLRELLCELGRPSM (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELGRPSM

SEQ ID NO: 349352 - protein, 19 aa, Artificial Sequence
  Description of Artificial Sequence: Synthetic peptide
  Seed: AYLHARLRELLCELGRPSM (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCELGRPSM

SEQ ID NO: 349353 - protein, 19 aa, Artificial Sequence
  Description of Artificial Sequence: Synthetic peptide
  Seed: AYLHARLRELLCELGRPSM (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSM

SEQ ID NO: 349354 - protein, 19 aa, Artificial Sequence
  Description of Artificial Sequence: Synthetic peptide
  Seed: AYLHARLRELLCELGRPSM (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSM

SEQ ID NO: 349355 - protein, 20 aa, Artificial Sequence
  Description of Artificial Sequence: Synthetic peptide
  Seed: AYLHARLRELLCELGRPSMV (PRAME_HUMAN)
  Core: YLHARLREL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXLHXRXREXLCELGRPSMV

SEQ ID NO: 349356 - protein, 20 aa, Artificial Sequence
  Description of Artificial Sequence: Synthetic peptide
  Seed: AYLHARLRELLCELGRPSMV (PRAME_HUMAN)
  Core: LHARLRELL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AYXHAXLXELXCELGRPSMV

SEQ ID NO: 349357 - protein, 20 aa, Artificial Sequence
  Description of Artificial Sequence: Synthetic peptide
  Seed: AYLHARLRELLCELGRPSMV (PRAME_HUMAN)
  Core: ARLRELLCE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AYLHXRLXEXLCXLGRPSMV

SEQ ID NO: 349358 - protein, 20 aa, Artificial Sequence
  Description of Artificial Sequence: Synthetic peptide
  Seed: AYLHARLRELLCELGRPSMV (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMV

SEQ ID NO: 349359 - protein, 20 aa, Artificial Sequence
  Description of Artificial Sequence: Synthetic peptide
  Seed: AYLHARLRELLCELGRPSMV (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMV

SEQ ID NO: 349360 - protein, 20 aa, Artificial Sequence
  Description of Artificial Sequence: Synthetic peptide
  Seed: AYLHARLRELLCELGRPSMV (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMV

SEQ ID NO: 349361 - protein, 21 aa, Artificial Sequence
  Description of Artificial Sequence: Synthetic peptide
  Seed: AYLHARLRELLCELGRPSMVW (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMVW

SEQ ID NO: 349362 - protein, 21 aa, Artificial Sequence
  Description of Artificial Sequence: Synthetic peptide
  Seed: AYLHARLRELLCELGRPSMVW (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMVW

SEQ ID NO: 349363 - protein, 21 aa, Artificial Sequence
  Description of Artificial Sequence: Synthetic peptide
  Seed: AYLHARLRELLCELGRPSMVW (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMVW

SEQ ID NO: 349364 - protein, 21 aa, Artificial Sequence
  Description of Artificial Sequence: Synthetic peptide
  Seed: AYLHARLRELLCELGRPSMVW (PRAME_HUMAN)
  Core: LCELGRPSM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELXCEXGXPSXVW

SEQ ID NO: 349365 - protein, 22 aa, Artificial Sequence
  Description of Artificial Sequence: Synthetic peptide
  Seed: AYLHARLRELLCELGRPSMVWL (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMVWL

SEQ ID NO: 349366 - protein, 22 aa, Artificial Sequence
  Description of Artificial Sequence: Synthetic peptide
  Seed: AYLHARLRELLCELGRPSMVWL (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMVWL

SEQ ID NO: 349367 - protein, 22 aa, Artificial Sequence
  Description of Artificial Sequence: Synthetic peptide
  Seed: AYLHARLRELLCELGRPSMVWL (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMVWL

SEQ ID NO: 349368 - protein, 22 aa, Artificial Sequence
  Description of Artificial Sequence: Synthetic peptide
  Seed: AYLHARLRELLCELGRPSMVWL (PRAME_HUMAN)
  Core: LCELGRPSM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELXCEXGXPSXVWL

SEQ ID NO: 349369 - protein, 23 aa, Artificial Sequence
  Description of Artificial Sequence: Synthetic peptide
  Seed: AYLHARLRELLCELGRPSMVWLS (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMVWLS

SEQ ID NO: 349370 - protein, 23 aa, Artificial Sequence
  Description of Artificial Sequence: Synthetic peptide
  Seed: AYLHARLRELLCELGRPSMVWLS (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMVWLS

SEQ ID NO: 349371 - protein, 23 aa, Artificial Sequence
  Description of Artificial Sequence: Synthetic peptide
  Seed: AYLHARLRELLCELGRPSMVWLS (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMVWLS

SEQ ID NO: 349372 - protein, 23 aa, Artificial Sequence
  Description of Artificial Sequence: Synthetic peptide
  Seed: AYLHARLRELLCELGRPSMVWLS (PRAME_HUMAN)
  Core: LCELGRPSM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELXCEXGXPSXVWLS

SEQ ID NO: 349373 - protein, 23 aa, Artificial Sequence
  Description of Artificial Sequence: Synthetic peptide
  Seed: AYLHARLRELLCELGRPSMVWLS (PRAME_HUMAN)
  Core: CELGRPSMV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELLXELXRXSMXWLS

SEQ ID NO: 349374 - protein, 24 aa, Artificial Sequence
  Description of Artificial Sequence: Synthetic peptide
  Seed: AYLHARLRELLCELGRPSMVWLSA (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMVWLSA

SEQ ID NO: 349375 - protein, 24 aa, Artificial Sequence
  Description of Artificial Sequence: Synthetic peptide
  Seed: AYLHARLRELLCELGRPSMVWLSA (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMVWLSA

SEQ ID NO: 349376 - protein, 24 aa, Artificial Sequence
  Description of Artificial Sequence: Synthetic peptide
  Seed: AYLHARLRELLCELGRPSMVWLSA (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMVWLSA

SEQ ID NO: 349377 - protein, 24 aa, Artificial Sequence
  Description of Artificial Sequence: Synthetic peptide
  Seed: AYLHARLRELLCELGRPSMVWLSA (PRAME_HUMAN)
  Core: LCELGRPSM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELXCEXGXPSXVWLSA

SEQ ID NO: 349378 - protein, 24 aa, Artificial Sequence
  Description of Artificial Sequence: Synthetic peptide
  Seed: AYLHARLRELLCELGRPSMVWLSA (PRAME_HUMAN)
  Core: CELGRPSMV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELLXELXRXSMXWLSA

SEQ ID NO: 349379 - protein, 24 aa, Artificial Sequence
  Description of Artificial Sequence: Synthetic peptide
  Seed: AYLHARLRELLCELGRPSMVWLSA (PRAME_HUMAN)
  Core: GRPSMVWLS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELLCELXRPXMXWLXA

SEQ ID NO: 349380 - protein, 25 aa, Artificial Sequence
  Description of Artificial Sequence: Synthetic peptide
  Seed: AYLHARLRELLCELGRPSMVWLSAN (PRAME_HUMAN)
  Core: RLRELLCEL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AYLHAXLRXLXCEXGRPSMVWLSAN

SEQ ID NO: 349381 - protein, 25 aa, Artificial Sequence
  Description of Artificial Sequence: Synthetic peptide
  Seed: AYLHARLRELLCELGRPSMVWLSAN (PRAME_HUMAN)
  Core: LRELLCELG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARXREXLXELXRPSMVWLSAN

SEQ ID NO: 349382 - protein, 25 aa, Artificial Sequence
  Description of Artificial Sequence: Synthetic peptide
  Seed: AYLHARLRELLCELGRPSMVWLSAN (PRAME_HUMAN)
  Core: LLCELGRPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLREXLCXLXRPXMVWLSAN

SEQ ID NO: 349383 - protein, 25 aa, Artificial Sequence
  Description of Artificial Sequence: Synthetic peptide
  Seed: AYLHARLRELLCELGRPSMVWLSAN (PRAME_HUMAN)
  Core: LCELGRPSM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELXCEXGXPSXVWLSAN

SEQ ID NO: 349384 - protein, 25 aa, Artificial Sequence
  Description of Artificial Sequence: Synthetic peptide
  Seed: AYLHARLRELLCELGRPSMVWLSAN (PRAME_HUMAN)
  Core: GRPSMVWLS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AYLHARLRELLCELXRPXMXWLXAN

SEQ ID NO: 349385 - protein, 13 aa, Artificial Sequence
  Description of Artificial Sequence: Synthetic peptide
  Seed: CCKKLKIFAMPMQ (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMX

SEQ ID NO: 349386 - protein, 14 aa, Artificial Sequence
  Description of Artificial Sequence: Synthetic peptide
  Seed: CCKKLKIFAMPMQD (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXD

SEQ ID NO: 349387 - protein, 14 aa, Artificial Sequence
  Description of Artificial Sequence: Synthetic peptide
  Seed: CCKKLKIFAMPMQD (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQX

SEQ ID NO: 349388 - protein, 15 aa, Artificial Sequence
  Description of Artificial Sequence: Synthetic peptide
  Seed: CCKKLKIFAMPMQDI (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDI

SEQ ID NO: 349389 - protein, 15 aa, Artificial Sequence
  Description of Artificial Sequence: Synthetic peptide
  Seed: CCKKLKIFAMPMQDI (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXI

SEQ ID NO: 349390 - protein, 15 aa, Artificial Sequence
  Description of Artificial Sequence: Synthetic peptide
  Seed: CCKKLKIFAMPMQDI (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDX

SEQ ID NO: 349391 - protein, 16 aa, Artificial Sequence
  Description of Artificial Sequence: Synthetic peptide
  Seed: CCKKLKIFAMPMQDIK (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIK

SEQ ID NO: 349392 - protein, 16 aa, Artificial Sequence
  Description of Artificial Sequence: Synthetic peptide
  Seed: CCKKLKIFAMPMQDIK (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIK

SEQ ID NO: 349393 - protein, 16 aa, Artificial Sequence
  Description of Artificial Sequence: Synthetic peptide
  Seed: CCKKLKIFAMPMQDIK (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXK

SEQ ID NO: 349394 - protein, 17 aa, Artificial Sequence
  Description of Artificial Sequence: Synthetic peptide
  Seed: CCKKLKIFAMPMQDIKM (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKM

SEQ ID NO: 349395 - protein, 17 aa, Artificial Sequence
  Description of Artificial Sequence: Synthetic peptide
  Seed: CCKKLKIFAMPMQDIKM (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKM

SEQ ID NO: 349396 - protein, 17 aa, Artificial Sequence
  Description of Artificial Sequence: Synthetic peptide
  Seed: CCKKLKIFAMPMQDIKM (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKM

SEQ ID NO: 349397 - protein, 17 aa, Artificial Sequence
  Description of Artificial Sequence: Synthetic peptide
  Seed: CCKKLKIFAMPMQDIKM (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKX

SEQ ID NO: 349398 - protein, 18 aa, Artificial Sequence
  Description of Artificial Sequence: Synthetic peptide
  Seed: CCKKLKIFAMPMQDIKMI (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMI

SEQ ID NO: 349399 - protein, 18 aa, Artificial Sequence
  Description of Artificial Sequence: Synthetic peptide
  Seed: CCKKLKIFAMPMQDIKMI (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMI

SEQ ID NO: 349400 - protein, 18 aa, Artificial Sequence
  Description of Artificial Sequence: Synthetic peptide
  Seed: CCKKLKIFAMPMQDIKMI (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMI

SEQ ID NO: 349401 - protein, 18 aa, Artificial Sequence
  Description of Artificial Sequence: Synthetic peptide
  Seed: CCKKLKIFAMPMQDIKMI (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXI

SEQ ID NO: 349402 - protein, 19 aa, Artificial Sequence
  Description of Artificial Sequence: Synthetic peptide
  Seed: CCKKLKIFAMPMQDIKMIL (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMIL

SEQ ID NO: 349403 - protein, 19 aa, Artificial Sequence
  Description of Artificial Sequence: Synthetic peptide
  Seed: CCKKLKIFAMPMQDIKMIL (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMIL

SEQ ID NO: 349404 - protein, 19 aa, Artificial Sequence
  Description of Artificial Sequence: Synthetic peptide
  Seed: CCKKLKIFAMPMQDIKMIL (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMIL

SEQ ID NO: 349405 - protein, 19 aa, Artificial Sequence
  Description of Artificial Sequence: Synthetic peptide
  Seed: CCKKLKIFAMPMQDIKMIL (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXIL

SEQ ID NO: 349406 - protein, 20 aa, Artificial Sequence
  Description of Artificial Sequence: Synthetic peptide
  Seed: CCKKLKIFAMPMQDIKMILK (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILK

SEQ ID NO: 349407 - protein, 20 aa, Artificial Sequence
  Description of Artificial Sequence: Synthetic peptide
  Seed: CCKKLKIFAMPMQDIKMILK (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILK

SEQ ID NO: 349408 - protein, 20 aa, Artificial Sequence
  Description of Artificial Sequence: Synthetic peptide
  Seed: CCKKLKIFAMPMQDIKMILK (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILK

SEQ ID NO: 349409 - protein, 20 aa, Artificial Sequence
  Description of Artificial Sequence: Synthetic peptide
  Seed: CCKKLKIFAMPMQDIKMILK (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILK

SEQ ID NO: 349410 - protein, 21 aa, Artificial Sequence
  Description of Artificial Sequence: Synthetic peptide
  Seed: CCKKLKIFAMPMQDIKMILKM (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILKM

SEQ ID NO: 349411 - protein, 21 aa, Artificial Sequence
  Description of Artificial Sequence: Synthetic peptide
  Seed: CCKKLKIFAMPMQDIKMILKM (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILKM

SEQ ID NO: 349412 - protein, 21 aa, Artificial Sequence
  Description of Artificial Sequence: Synthetic peptide
  Seed: CCKKLKIFAMPMQDIKMILKM (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILKM

SEQ ID NO: 349413 - protein, 21 aa, Artificial Sequence
  Description of Artificial Sequence: Synthetic peptide
  Seed: CCKKLKIFAMPMQDIKMILKM (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILKM

SEQ ID NO: 349414 - protein, 22 aa, Artificial Sequence
  Description of Artificial Sequence: Synthetic peptide
  Seed: CCKKLKIFAMPMQDIKMILKMV (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILKMV

SEQ ID NO: 349415 - protein, 22 aa, Artificial Sequence
  Description of Artificial Sequence: Synthetic peptide
  Seed: CCKKLKIFAMPMQDIKMILKMV (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILKMV

SEQ ID NO: 349416 - protein, 22 aa, Artificial Sequence
  Description of Artificial Sequence: Synthetic peptide
  Seed: CCKKLKIFAMPMQDIKMILKMV (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILKMV

SEQ ID NO: 349417 - protein, 22 aa, Artificial Sequence
  Description of Artificial Sequence: Synthetic peptide
  Seed: CCKKLKIFAMPMQDIKMILKMV (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILKMV

SEQ ID NO: 349418 - protein, 23 aa, Artificial Sequence
  Description of Artificial Sequence: Synthetic peptide
  Seed: CCKKLKIFAMPMQDIKMILKMVQ (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILKMVQ

SEQ ID NO: 349419 - protein, 23 aa, Artificial Sequence
  Description of Artificial Sequence: Synthetic peptide
  Seed: CCKKLKIFAMPMQDIKMILKMVQ (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILKMVQ

SEQ ID NO: 349420 - protein, 23 aa, Artificial Sequence
  Description of Artificial Sequence: Synthetic peptide
  Seed: CCKKLKIFAMPMQDIKMILKMVQ (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILKMVQ

SEQ ID NO: 349421 - protein, 23 aa, Artificial Sequence
  Description of Artificial Sequence: Synthetic peptide
  Seed: CCKKLKIFAMPMQDIKMILKMVQ (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILKMVQ

SEQ ID NO: 349422 - protein, 23 aa, Artificial Sequence
  Description of Artificial Sequence: Synthetic peptide
  Seed: CCKKLKIFAMPMQDIKMILKMVQ (PRAME_HUMAN)
  Core: IKMILKMVQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFAMPMQDXKMXLXMVX

SEQ ID NO: 349423 - protein, 24 aa, Artificial Sequence
  Description of Artificial Sequence: Synthetic peptide
  Seed: CCKKLKIFAMPMQDIKMILKMVQL (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILKMVQL

SEQ ID NO: 349424 - protein, 24 aa, Artificial Sequence
  Description of Artificial Sequence: Synthetic peptide
  Seed: CCKKLKIFAMPMQDIKMILKMVQL (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILKMVQL

SEQ ID NO: 349425 - protein, 24 aa, Artificial Sequence
  Description of Artificial Sequence: Synthetic peptide
  Seed: CCKKLKIFAMPMQDIKMILKMVQL (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILKMVQL

SEQ ID NO: 349426 - protein, 24 aa, Artificial Sequence
  Description of Artificial Sequence: Synthetic peptide
  Seed: CCKKLKIFAMPMQDIKMILKMVQL (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILKMVQL

SEQ ID NO: 349427 - protein, 24 aa, Artificial Sequence
  Description of Artificial Sequence: Synthetic peptide
  Seed: CCKKLKIFAMPMQDIKMILKMVQL (PRAME_HUMAN)
  Core: IKMILKMVQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFAMPMQDXKMXLXMVXL

SEQ ID NO: 349428 - protein, 25 aa, Artificial Sequence
  Description of Artificial Sequence: Synthetic peptide
  Seed: CCKKLKIFAMPMQDIKMILKMVQLD (PRAME_HUMAN)
  Core: LKIFAMPMQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CCKKXKIXAXPMXDIKMILKMVQLD

SEQ ID NO: 349429 - protein, 25 aa, Artificial Sequence
  Description of Artificial Sequence: Synthetic peptide
  Seed: CCKKLKIFAMPMQDIKMILKMVQLD (PRAME_HUMAN)
  Core: KIFAMPMQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLXIFXMXMQXIKMILKMVQLD

SEQ ID NO: 349430 - protein, 25 aa, Artificial Sequence
  Description of Artificial Sequence: Synthetic peptide
  Seed: CCKKLKIFAMPMQDIKMILKMVQLD (PRAME_HUMAN)
  Core: IFAMPMQDI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKXFAXPXQDXKMILKMVQLD

SEQ ID NO: 349431 - protein, 25 aa, Artificial Sequence
  Description of Artificial Sequence: Synthetic peptide
  Seed: CCKKLKIFAMPMQDIKMILKMVQLD (PRAME_HUMAN)
  Core: AMPMQDIKM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFXMPXQXIKXILKMVQLD

SEQ ID NO: 349432 - protein, 25 aa, Artificial Sequence
  Description of Artificial Sequence: Synthetic peptide
  Seed: CCKKLKIFAMPMQDIKMILKMVQLD (PRAME_HUMAN)
  Core: IKMILKMVQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CCKKLKIFAMPMQDXKMXLXMVXLD

SEQ ID NO: 349433 - protein, 13 aa, Artificial Sequence
  Description of Artificial Sequence: Synthetic peptide
  Seed: CDELFSYLIEKVK (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXK

SEQ ID NO: 349434 - protein, 14 aa, Artificial Sequence
  Description of Artificial Sequence: Synthetic peptide
  Seed: CDELFSYLIEKVKR (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKR

SEQ ID NO: 349435 - protein, 14 aa, Artificial Sequence
  Description of Artificial Sequence: Synthetic peptide
  Seed: CDELFSYLIEKVKR (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXR

SEQ ID NO: 349436 - protein, 15 aa, Artificial Sequence
  Description of Artificial Sequence: Synthetic peptide
  Seed: CDELFSYLIEKVKRK (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRK

SEQ ID NO: 349437 - protein, 15 aa, Artificial Sequence
  Description of Artificial Sequence: Synthetic peptide
  Seed: CDELFSYLIEKVKRK (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRK

SEQ ID NO: 349438 - protein, 16 aa, Artificial Sequence
  Description of Artificial Sequence: Synthetic peptide
  Seed: CDELFSYLIEKVKRKK (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKK

SEQ ID NO: 349439 - protein, 16 aa, Artificial Sequence
  Description of Artificial Sequence: Synthetic peptide
  Seed: CDELFSYLIEKVKRKK (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKK

SEQ ID NO: 349440 - protein, 17 aa, Artificial Sequence
  Description of Artificial Sequence: Synthetic peptide
  Seed: CDELFSYLIEKVKRKKN (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKN

SEQ ID NO: 349441 - protein, 17 aa, Artificial Sequence
  Description of Artificial Sequence: Synthetic peptide
  Seed: CDELFSYLIEKVKRKKN (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKN

SEQ ID NO: 349442 - protein, 17 aa, Artificial Sequence
  Description of Artificial Sequence: Synthetic peptide
  Seed: CDELFSYLIEKVKRKKN (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKN

SEQ ID NO: 349443 - protein, 17 aa, Artificial Sequence
  Description of Artificial Sequence: Synthetic peptide
  Seed: CDELFSYLIEKVKRKKN (PRAME_HUMAN)
  Core: LIEKVKRKK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYXIEXVXRKXN

SEQ ID NO: 349444 - protein, 17 aa, Artificial Sequence
  Description of Artificial Sequence: Synthetic peptide
  Seed: CDELFSYLIEKVKRKKN (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKX

SEQ ID NO: 349445 - protein, 18 aa, Artificial Sequence
  Description of Artificial Sequence: Synthetic peptide
  Seed: CDELFSYLIEKVKRKKNV (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNV

SEQ ID NO: 349446 - protein, 18 aa, Artificial Sequence
  Description of Artificial Sequence: Synthetic peptide
  Seed: CDELFSYLIEKVKRKKNV (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNV

SEQ ID NO: 349447 - protein, 18 aa, Artificial Sequence
  Description of Artificial Sequence: Synthetic peptide
  Seed: CDELFSYLIEKVKRKKNV (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNV

SEQ ID NO: 349448 - protein, 18 aa, Artificial Sequence
  Description of Artificial Sequence: Synthetic peptide
  Seed: CDELFSYLIEKVKRKKNV (PRAME_HUMAN)
  Core: LIEKVKRKK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYXIEXVXRKXNV

SEQ ID NO: 349449 - protein, 18 aa, Artificial Sequence
  Description of Artificial Sequence: Synthetic peptide
  Seed: CDELFSYLIEKVKRKKNV (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXV

SEQ ID NO: 349450 - protein, 19 aa, Artificial Sequence
  Description of Artificial Sequence: Synthetic peptide
  Seed: CDELFSYLIEKVKRKKNVL (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVL

SEQ ID NO: 349451 - protein, 19 aa, Artificial Sequence
  Description of Artificial Sequence: Synthetic peptide
  Seed: CDELFSYLIEKVKRKKNVL (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVL

SEQ ID NO: 349452 - protein, 19 aa, Artificial Sequence
  Description of Artificial Sequence: Synthetic peptide
  Seed: CDELFSYLIEKVKRKKNVL (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVL

SEQ ID NO: 349453 - protein, 19 aa, Artificial Sequence
  Description of Artificial Sequence: Synthetic peptide
  Seed: CDELFSYLIEKVKRKKNVL (PRAME_HUMAN)
  Core: LIEKVKRKK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYXIEXVXRKXNVL

SEQ ID NO: 349454 - protein, 19 aa, Artificial Sequence
  Description of Artificial Sequence: Synthetic peptide
  Seed: CDELFSYLIEKVKRKKNVL (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVL

SEQ ID NO: 349455 - protein, 20 aa, Artificial Sequence
  Description of Artificial Sequence: Synthetic peptide
  Seed: CDELFSYLIEKVKRKKNVLR (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLR

SEQ ID NO: 349456 - protein, 20 aa, Artificial Sequence
  Description of Artificial Sequence: Synthetic peptide
  Seed: CDELFSYLIEKVKRKKNVLR (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLR

SEQ ID NO: 349457 - protein, 20 aa, Artificial Sequence
  Description of Artificial Sequence: Synthetic peptide
  Seed: CDELFSYLIEKVKRKKNVLR (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLR

SEQ ID NO: 349458 - protein, 20 aa, Artificial Sequence
  Description of Artificial Sequence: Synthetic peptide
  Seed: CDELFSYLIEKVKRKKNVLR (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLR

SEQ ID NO: 349459 - protein, 21 aa, Artificial Sequence
  Description of Artificial Sequence: Synthetic peptide
  Seed: CDELFSYLIEKVKRKKNVLRL (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLRL

SEQ ID NO: 349460 - protein, 21 aa, Artificial Sequence
  Description of Artificial Sequence: Synthetic peptide
  Seed: CDELFSYLIEKVKRKKNVLRL (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLRL

SEQ ID NO: 349461 - protein, 21 aa, Artificial Sequence
  Description of Artificial Sequence: Synthetic peptide
  Seed: CDELFSYLIEKVKRKKNVLRL (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLRL

SEQ ID NO: 349462 - protein, 21 aa, Artificial Sequence
  Description of Artificial Sequence: Synthetic peptide
  Seed: CDELFSYLIEKVKRKKNVLRL (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLRL

SEQ ID NO: 349463 - protein, 21 aa, Artificial Sequence
  Description of Artificial Sequence: Synthetic peptide
  Seed: CDELFSYLIEKVKRKKNVLRL (PRAME_HUMAN)
  Core: VKRKKNVLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKXKRXKXVLXL

SEQ ID NO: 349464 - protein, 21 aa, Artificial Sequence
  Description of Artificial Sequence: Synthetic peptide
  Seed: CDELFSYLIEKVKRKKNVLRL (PRAME_HUMAN)
  Core: KRKKNVLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVXRKXNXLRX

SEQ ID NO: 349465 - protein, 22 aa, Artificial Sequence
  Description of Artificial Sequence: Synthetic peptide
  Seed: CDELFSYLIEKVKRKKNVLRLC (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLRLC

SEQ ID NO: 349466 - protein, 22 aa, Artificial Sequence
  Description of Artificial Sequence: Synthetic peptide
  Seed: CDELFSYLIEKVKRKKNVLRLC (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLRLC

SEQ ID NO: 349467 - protein, 22 aa, Artificial Sequence
  Description of Artificial Sequence: Synthetic peptide
  Seed: CDELFSYLIEKVKRKKNVLRLC (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLRLC

SEQ ID NO: 349468 - protein, 22 aa, Artificial Sequence
  Description of Artificial Sequence: Synthetic peptide
  Seed: CDELFSYLIEKVKRKKNVLRLC (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLRLC

SEQ ID NO: 349469 - protein, 22 aa, Artificial Sequence
  Description of Artificial Sequence: Synthetic peptide
  Seed: CDELFSYLIEKVKRKKNVLRLC (PRAME_HUMAN)
  Core: KRKKNVLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVXRKXNXLRXC

SEQ ID NO: 349470 - protein, 23 aa, Artificial Sequence
  Description of Artificial Sequence: Synthetic peptide
  Seed: CDELFSYLIEKVKRKKNVLRLCC (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLRLCC

SEQ ID NO: 349471 - protein, 23 aa, Artificial Sequence
  Description of Artificial Sequence: Synthetic peptide
  Seed: CDELFSYLIEKVKRKKNVLRLCC (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLRLCC

SEQ ID NO: 349472 - protein, 23 aa, Artificial Sequence
  Description of Artificial Sequence: Synthetic peptide
  Seed: CDELFSYLIEKVKRKKNVLRLCC (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLRLCC

SEQ ID NO: 349473 - protein, 23 aa, Artificial Sequence
  Description of Artificial Sequence: Synthetic peptide
  Seed: CDELFSYLIEKVKRKKNVLRLCC (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLRLCC

SEQ ID NO: 349474 - protein, 23 aa, Artificial Sequence
  Description of Artificial Sequence: Synthetic peptide
  Seed: CDELFSYLIEKVKRKKNVLRLCC (PRAME_HUMAN)
  Core: KRKKNVLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVXRKXNXLRXCC

SEQ ID NO: 349475 - protein, 24 aa, Artificial Sequence
  Description of Artificial Sequence: Synthetic peptide
  Seed: CDELFSYLIEKVKRKKNVLRLCCK (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLRLCCK

SEQ ID NO: 349476 - protein, 24 aa, Artificial Sequence
  Description of Artificial Sequence: Synthetic peptide
  Seed: CDELFSYLIEKVKRKKNVLRLCCK (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLRLCCK

SEQ ID NO: 349477 - protein, 24 aa, Artificial Sequence
  Description of Artificial Sequence: Synthetic peptide
  Seed: CDELFSYLIEKVKRKKNVLRLCCK (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLRLCCK

SEQ ID NO: 349478 - protein, 24 aa, Artificial Sequence
  Description of Artificial Sequence: Synthetic peptide
  Seed: CDELFSYLIEKVKRKKNVLRLCCK (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLRLCCK

SEQ ID NO: 349479 - protein, 24 aa, Artificial Sequence
  Description of Artificial Sequence: Synthetic peptide
  Seed: CDELFSYLIEKVKRKKNVLRLCCK (PRAME_HUMAN)
  Core: KRKKNVLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVXRKXNXLRXCCK

SEQ ID NO: 349480 - protein, 25 aa, Artificial Sequence
  Description of Artificial Sequence: Synthetic peptide
  Seed: CDELFSYLIEKVKRKKNVLRLCCKK (PRAME_HUMAN)
  Core: LFSYLIEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CDEXFSXLXEKXKRKKNVLRLCCKK

SEQ ID NO: 349481 - protein, 25 aa, Artificial Sequence
  Description of Artificial Sequence: Synthetic peptide
  Seed: CDELFSYLIEKVKRKKNVLRLCCKK (PRAME_HUMAN)
  Core: FSYLIEKVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CDELXSYXIXKVXRKKNVLRLCCKK

SEQ ID NO: 349482 - protein, 25 aa, Artificial Sequence
  Description of Artificial Sequence: Synthetic peptide
  Seed: CDELFSYLIEKVKRKKNVLRLCCKK (PRAME_HUMAN)
  Core: YLIEKVKRK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSXLIXKXKRXKNVLRLCCKK

SEQ ID NO: 349483 - protein, 25 aa, Artificial Sequence
  Description of Artificial Sequence: Synthetic peptide
  Seed: CDELFSYLIEKVKRKKNVLRLCCKK (PRAME_HUMAN)
  Core: IEKVKRKKN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLXEKXKXKKXVLRLCCKK

SEQ ID NO: 349484 - protein, 25 aa, Artificial Sequence
  Description of Artificial Sequence: Synthetic peptide
  Seed: CDELFSYLIEKVKRKKNVLRLCCKK (PRAME_HUMAN)
  Core: KRKKNVLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVXRKXNXLRXCCKK

SEQ ID NO: 349485 - protein, 25 aa, Artificial Sequence
  Description of Artificial Sequence: Synthetic peptide
  Seed: CDELFSYLIEKVKRKKNVLRLCCKK (PRAME_HUMAN)
  Core: RKKNVLRLC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CDELFSYLIEKVKXKKXVXRLXCKK

SEQ ID NO: 349486 - protein, 13 aa, Artificial Sequence
  Description of Artificial Sequence: Synthetic peptide
  Seed: CELGRPSMVWLSA (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXA

SEQ ID NO: 349487 - protein, 14 aa, Artificial Sequence
  Description of Artificial Sequence: Synthetic peptide
  Seed: CELGRPSMVWLSAN (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXAN

SEQ ID NO: 349488 - protein, 15 aa, Artificial Sequence
  Description of Artificial Sequence: Synthetic peptide
  Seed: CELGRPSMVWLSANP (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANP

SEQ ID NO: 349489 - protein, 15 aa, Artificial Sequence
  Description of Artificial Sequence: Synthetic peptide
  Seed: CELGRPSMVWLSANP (PRAME_HUMAN)
  Core: RPSMVWLSA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CELGXPSXVXLSXNP

SEQ ID NO: 349490 - protein, 16 aa, Artificial Sequence
  Description of Artificial Sequence: Synthetic peptide
  Seed: CELGRPSMVWLSANPC (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPC

SEQ ID NO: 349491 - protein, 16 aa, Artificial Sequence
  Description of Artificial Sequence: Synthetic peptide
  Seed: CELGRPSMVWLSANPC (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPX

SEQ ID NO: 349492 - protein, 17 aa, Artificial Sequence
  Description of Artificial Sequence: Synthetic peptide
  Seed: CELGRPSMVWLSANPCP (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCP

SEQ ID NO: 349493 - protein, 17 aa, Artificial Sequence
  Description of Artificial Sequence: Synthetic peptide
  Seed: CELGRPSMVWLSANPCP (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXP

SEQ ID NO: 349494 - protein, 18 aa, Artificial Sequence
  Description of Artificial Sequence: Synthetic peptide
  Seed: CELGRPSMVWLSANPCPH (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPH

SEQ ID NO: 349495 - protein, 18 aa, Artificial Sequence
  Description of Artificial Sequence: Synthetic peptide
  Seed: CELGRPSMVWLSANPCPH (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPH

SEQ ID NO: 349496 - protein, 19 aa, Artificial Sequence
  Description of Artificial Sequence: Synthetic peptide
  Seed: CELGRPSMVWLSANPCPHC (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHC

SEQ ID NO: 349497 - protein, 19 aa, Artificial Sequence
  Description of Artificial Sequence: Synthetic peptide
  Seed: CELGRPSMVWLSANPCPHC (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHC

SEQ ID NO: 349498 - protein, 20 aa, Artificial Sequence
  Description of Artificial Sequence: Synthetic peptide
  Seed: CELGRPSMVWLSANPCPHCG (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCG

SEQ ID NO: 349499 - protein, 20 aa, Artificial Sequence
  Description of Artificial Sequence: Synthetic peptide
  Seed: CELGRPSMVWLSANPCPHCG (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCG

SEQ ID NO: 349500 - protein, 20 aa, Artificial Sequence
  Description of Artificial Sequence: Synthetic peptide
  Seed: CELGRPSMVWLSANPCPHCG (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCG

SEQ ID NO: 349501 - protein, 21 aa, Artificial Sequence
  Description of Artificial Sequence: Synthetic peptide
  Seed: CELGRPSMVWLSANPCPHCGD (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCGD

SEQ ID NO: 349502 - protein, 21 aa, Artificial Sequence
  Description of Artificial Sequence: Synthetic peptide
  Seed: CELGRPSMVWLSANPCPHCGD (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCGD

SEQ ID NO: 349503 - protein, 21 aa, Artificial Sequence
  Description of Artificial Sequence: Synthetic peptide
  Seed: CELGRPSMVWLSANPCPHCGD (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCGD

SEQ ID NO: 349504 - protein, 22 aa, Artificial Sequence
  Description of Artificial Sequence: Synthetic peptide
  Seed: CELGRPSMVWLSANPCPHCGDR (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCGDR

SEQ ID NO: 349505 - protein, 22 aa, Artificial Sequence
  Description of Artificial Sequence: Synthetic peptide
  Seed: CELGRPSMVWLSANPCPHCGDR (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCGDR

SEQ ID NO: 349506 - protein, 22 aa, Artificial Sequence
  Description of Artificial Sequence: Synthetic peptide
  Seed: CELGRPSMVWLSANPCPHCGDR (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCGDR

SEQ ID NO: 349507 - protein, 23 aa, Artificial Sequence
  Description of Artificial Sequence: Synthetic peptide
  Seed: CELGRPSMVWLSANPCPHCGDRT (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCGDRT

SEQ ID NO: 349508 - protein, 23 aa, Artificial Sequence
  Description of Artificial Sequence: Synthetic peptide
  Seed: CELGRPSMVWLSANPCPHCGDRT (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCGDRT

SEQ ID NO: 349509 - protein, 23 aa, Artificial Sequence
  Description of Artificial Sequence: Synthetic peptide
  Seed: CELGRPSMVWLSANPCPHCGDRT (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCGDRT

SEQ ID NO: 349510 - protein, 24 aa, Artificial Sequence
  Description of Artificial Sequence: Synthetic peptide
  Seed: CELGRPSMVWLSANPCPHCGDRTF (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCGDRTF

SEQ ID NO: 349511 - protein, 24 aa, Artificial Sequence
  Description of Artificial Sequence: Synthetic peptide
  Seed: CELGRPSMVWLSANPCPHCGDRTF (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCGDRTF

SEQ ID NO: 349512 - protein, 24 aa, Artificial Sequence
  Description of Artificial Sequence: Synthetic peptide
  Seed: CELGRPSMVWLSANPCPHCGDRTF (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCGDRTF

SEQ ID NO: 349513 - protein, 25 aa, Artificial Sequence
  Description of Artificial Sequence: Synthetic peptide
  Seed: CELGRPSMVWLSANPCPHCGDRTFY (PRAME_HUMAN)
  Core: GRPSMVWLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CELXRPXMXWLXANPCPHCGDRTFY

SEQ ID NO: 349514 - protein, 25 aa, Artificial Sequence
  Description of Artificial Sequence: Synthetic peptide
  Seed: CELGRPSMVWLSANPCPHCGDRTFY (PRAME_HUMAN)
  Core: MVWLSANPC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSXVWXSXNPXPHCGDRTFY

SEQ ID NO: 349515 - protein, 25 aa, Artificial Sequence
  Description of Artificial Sequence: Synthetic peptide
  Seed: CELGRPSMVWLSANPCPHCGDRTFY (PRAME_HUMAN)
  Core: WLSANPCPH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CELGRPSMVXLSXNXCPXCGDRTFY

SEQ ID NO: 349516 - protein, 20 aa, Artificial Sequence
  Description of Artificial Sequence: Synthetic peptide
  Seed: CGDRTFYDPEPILCPCFMPN (PRAME_HUMAN)
  Core: RTFYDPEPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CGDXTFXDXEPXLCPCFMPN

SEQ ID NO: 349517 - protein, 20 aa, Artificial Sequence
  Description of Artificial Sequence: Synthetic peptide
  Seed: CGDRTFYDPEPILCPCFMPN (PRAME_HUMAN)
  Core: FYDPEPILC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGDRTXYDXEXILXPCFMPN

SEQ ID NO: 349518 - protein, 14 aa, Artificial Sequence
  Description of Artificial Sequence: Synthetic peptide
  Seed: CGITDDQLLALLPS (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPS

SEQ ID NO: 349519 - protein, 15 aa, Artificial Sequence
  Description of Artificial Sequence: Synthetic peptide
  Seed: CGITDDQLLALLPSL (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSL

SEQ ID NO: 349520 - protein, 15 aa, Artificial Sequence
  Description of Artificial Sequence: Synthetic peptide
  Seed: CGITDDQLLALLPSL (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXL

SEQ ID NO: 349521 - protein, 16 aa, Artificial Sequence
  Description of Artificial Sequence: Synthetic peptide
  Seed: CGITDDQLLALLPSLS (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLS

SEQ ID NO: 349522 - protein, 16 aa, Artificial Sequence
  Description of Artificial Sequence: Synthetic peptide
  Seed: CGITDDQLLALLPSLS (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXLS

SEQ ID NO: 349523 - protein, 16 aa, Artificial Sequence
  Description of Artificial Sequence: Synthetic peptide
  Seed: CGITDDQLLALLPSLS (PRAME_HUMAN)
  Core: QLLALLPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDXLLXLXPSXS

SEQ ID NO: 349524 - protein, 16 aa, Artificial Sequence
  Description of Artificial Sequence: Synthetic peptide
  Seed: CGITDDQLLALLPSLS (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLX

SEQ ID NO: 349525 - protein, 17 aa, Artificial Sequence
  Description of Artificial Sequence: Synthetic peptide
  Seed: CGITDDQLLALLPSLSH (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSH

SEQ ID NO: 349526 - protein, 17 aa, Artificial Sequence
  Description of Artificial Sequence: Synthetic peptide
  Seed: CGITDDQLLALLPSLSH (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXLSH

SEQ ID NO: 349527 - protein, 17 aa, Artificial Sequence
  Description of Artificial Sequence: Synthetic peptide
  Seed: CGITDDQLLALLPSLSH (PRAME_HUMAN)
  Core: QLLALLPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDXLLXLXPSXSH

SEQ ID NO: 349528 - protein, 17 aa, Artificial Sequence
  Description of Artificial Sequence: Synthetic peptide
  Seed: CGITDDQLLALLPSLSH (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXH

SEQ ID NO: 349529 - protein, 18 aa, Artificial Sequence
  Description of Artificial Sequence: Synthetic peptide
  Seed: CGITDDQLLALLPSLSHC (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHC

SEQ ID NO: 349530 - protein, 18 aa, Artificial Sequence
  Description of Artificial Sequence: Synthetic peptide
  Seed: CGITDDQLLALLPSLSHC (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXLSHC

SEQ ID NO: 349531 - protein, 18 aa, Artificial Sequence
  Description of Artificial Sequence: Synthetic peptide
  Seed: CGITDDQLLALLPSLSHC (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHC

SEQ ID NO: 349532 - protein, 18 aa, Artificial Sequence
  Description of Artificial Sequence: Synthetic peptide
  Seed: CGITDDQLLALLPSLSHC (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXC

SEQ ID NO: 349533 - protein, 19 aa, Artificial Sequence
  Description of Artificial Sequence: Synthetic peptide
  Seed: CGITDDQLLALLPSLSHCS (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCS

SEQ ID NO: 349534 - protein, 19 aa, Artificial Sequence
  Description of Artificial Sequence: Synthetic peptide
  Seed: CGITDDQLLALLPSLSHCS (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCS

SEQ ID NO: 349535 - protein, 19 aa, Artificial Sequence
  Description of Artificial Sequence: Synthetic peptide
  Seed: CGITDDQLLALLPSLSHCS (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCS

SEQ ID NO: 349536 - protein, 20 aa, Artificial Sequence
  Description of Artificial Sequence: Synthetic peptide
  Seed: CGITDDQLLALLPSLSHCSQ (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQ

SEQ ID NO: 349537 - protein, 20 aa, Artificial Sequence
  Description of Artificial Sequence: Synthetic peptide
  Seed: CGITDDQLLALLPSLSHCSQ (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXLSHCSQ

SEQ ID NO: 349538 - protein, 20 aa, Artificial Sequence
  Description of Artificial Sequence: Synthetic peptide
  Seed: CGITDDQLLALLPSLSHCSQ (PRAME_HUMAN)
  Core: QLLALLPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDXLLXLXPSXSHCSQ

SEQ ID NO: 349539 - protein, 20 aa, Artificial Sequence
  Description of Artificial Sequence: Synthetic peptide
  Seed: CGITDDQLLALLPSLSHCSQ (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQ

SEQ ID NO: 349540 - protein, 20 aa, Artificial Sequence
  Description of Artificial Sequence: Synthetic peptide
  Seed: CGITDDQLLALLPSLSHCSQ (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQ

SEQ ID NO: 349541 - protein, 20 aa, Artificial Sequence
  Description of Artificial Sequence: Synthetic peptide
  Seed: CGITDDQLLALLPSLSHCSQ (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQ

SEQ ID NO: 349542 - protein, 21 aa, Artificial Sequence
  Description of Artificial Sequence: Synthetic peptide
  Seed: CGITDDQLLALLPSLSHCSQL (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQL

SEQ ID NO: 349543 - protein, 21 aa, Artificial Sequence
  Description of Artificial Sequence: Synthetic peptide
  Seed: CGITDDQLLALLPSLSHCSQL (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQL

SEQ ID NO: 349544 - protein, 21 aa, Artificial Sequence
  Description of Artificial Sequence: Synthetic peptide
  Seed: CGITDDQLLALLPSLSHCSQL (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQL

SEQ ID NO: 349545 - protein, 21 aa, Artificial Sequence
  Description of Artificial Sequence: Synthetic peptide
  Seed: CGITDDQLLALLPSLSHCSQL (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQL

SEQ ID NO: 349546 - protein, 22 aa, Artificial Sequence
  Description of Artificial Sequence: Synthetic peptide
  Seed: CGITDDQLLALLPSLSHCSQLT (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQLT

SEQ ID NO: 349547 - protein, 22 aa, Artificial Sequence
  Description of Artificial Sequence: Synthetic peptide
  Seed: CGITDDQLLALLPSLSHCSQLT (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQLT

SEQ ID NO: 349548 - protein, 22 aa, Artificial Sequence
  Description of Artificial Sequence: Synthetic peptide
  Seed: CGITDDQLLALLPSLSHCSQLT (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQLT

SEQ ID NO: 349549 - protein, 22 aa, Artificial Sequence
  Description of Artificial Sequence: Synthetic peptide
  Seed: CGITDDQLLALLPSLSHCSQLT (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQLT

SEQ ID NO: 349550 - protein, 23 aa, Artificial Sequence
  Description of Artificial Sequence: Synthetic peptide
  Seed: CGITDDQLLALLPSLSHCSQLTT (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQLTT

SEQ ID NO: 349551 - protein, 23 aa, Artificial Sequence
  Description of Artificial Sequence: Synthetic peptide
  Seed: CGITDDQLLALLPSLSHCSQLTT (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQLTT

SEQ ID NO: 349552 - protein, 23 aa, Artificial Sequence
  Description of Artificial Sequence: Synthetic peptide
  Seed: CGITDDQLLALLPSLSHCSQLTT (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQLTT

SEQ ID NO: 349553 - protein, 23 aa, Artificial Sequence
  Description of Artificial Sequence: Synthetic peptide
  Seed: CGITDDQLLALLPSLSHCSQLTT (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQLTT

SEQ ID NO: 349554 - protein, 24 aa, Artificial Sequence
  Description of Artificial Sequence: Synthetic peptide
  Seed: CGITDDQLLALLPSLSHCSQLTTL (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQLTTL

SEQ ID NO: 349555 - protein, 24 aa, Artificial Sequence
  Description of Artificial Sequence: Synthetic peptide
  Seed: CGITDDQLLALLPSLSHCSQLTTL (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQLTTL

SEQ ID NO: 349556 - protein, 24 aa, Artificial Sequence
  Description of Artificial Sequence: Synthetic peptide
  Seed: CGITDDQLLALLPSLSHCSQLTTL (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQLTTL

SEQ ID NO: 349557 - protein, 24 aa, Artificial Sequence
  Description of Artificial Sequence: Synthetic peptide
  Seed: CGITDDQLLALLPSLSHCSQLTTL (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQLTTL

SEQ ID NO: 349558 - protein, 25 aa, Artificial Sequence
  Description of Artificial Sequence: Synthetic peptide
  Seed: CGITDDQLLALLPSLSHCSQLTTLS (PRAME_HUMAN)
  Core: ITDDQLLAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CGXTDXQXLAXLPSLSHCSQLTTLS

SEQ ID NO: 349559 - protein, 25 aa, Artificial Sequence
  Description of Artificial Sequence: Synthetic peptide
  Seed: CGITDDQLLALLPSLSHCSQLTTLS (PRAME_HUMAN)
  Core: DQLLALLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CGITDXQLXAXLPXLSHCSQLTTLS

SEQ ID NO: 349560 - protein, 25 aa, Artificial Sequence
  Description of Artificial Sequence: Synthetic peptide
  Seed: CGITDDQLLALLPSLSHCSQLTTLS (PRAME_HUMAN)
  Core: LLALLPSLS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQXLAXLXSLXHCSQLTTLS

SEQ ID NO: 349561 - protein, 25 aa, Artificial Sequence
  Description of Artificial Sequence: Synthetic peptide
  Seed: CGITDDQLLALLPSLSHCSQLTTLS (PRAME_HUMAN)
  Core: LALLPSLSH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLXALXPXLSXCSQLTTLS

SEQ ID NO: 349562 - protein, 25 aa, Artificial Sequence
  Description of Artificial Sequence: Synthetic peptide
  Seed: CGITDDQLLALLPSLSHCSQLTTLS (PRAME_HUMAN)
  Core: LLPSLSHCS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CGITDDQLLAXLPXLXHCXQLTTLS

SEQ ID NO: 349563 - protein, 13 aa, Artificial Sequence
  Description of Artificial Sequence: Synthetic peptide
  Seed: CKKLKIFAMPMQD (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXD

SEQ ID NO: 349564 - protein, 13 aa, Artificial Sequence
  Description of Artificial Sequence: Synthetic peptide
  Seed: CKKLKIFAMPMQD (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQX

SEQ ID NO: 349565 - protein, 14 aa, Artificial Sequence
  Description of Artificial Sequence: Synthetic peptide
  Seed: CKKLKIFAMPMQDI (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDI

SEQ ID NO: 349566 - protein, 14 aa, Artificial Sequence
  Description of Artificial Sequence: Synthetic peptide
  Seed: CKKLKIFAMPMQDI (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXI

SEQ ID NO: 349567 - protein, 14 aa, Artificial Sequence
  Description of Artificial Sequence: Synthetic peptide
  Seed: CKKLKIFAMPMQDI (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDX

SEQ ID NO: 349568 - protein, 15 aa, Artificial Sequence
  Description of Artificial Sequence: Synthetic peptide
  Seed: CKKLKIFAMPMQDIK (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIK

SEQ ID NO: 349569 - protein, 15 aa, Artificial Sequence
  Description of Artificial Sequence: Synthetic peptide
  Seed: CKKLKIFAMPMQDIK (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIK

SEQ ID NO: 349570 - protein, 15 aa, Artificial Sequence
  Description of Artificial Sequence: Synthetic peptide
  Seed: CKKLKIFAMPMQDIK (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXK

SEQ ID NO: 349571 - protein, 16 aa, Artificial Sequence
  Description of Artificial Sequence: Synthetic peptide
  Seed: CKKLKIFAMPMQDIKM (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKM

SEQ ID NO: 349572 - protein, 16 aa, Artificial Sequence
  Description of Artificial Sequence: Synthetic peptide
  Seed: CKKLKIFAMPMQDIKM (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKM

SEQ ID NO: 349573 - protein, 16 aa, Artificial Sequence
  Description of Artificial Sequence: Synthetic peptide
  Seed: CKKLKIFAMPMQDIKM (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKM

SEQ ID NO: 349574 - protein, 16 aa, Artificial Sequence
  Description of Artificial Sequence: Synthetic peptide
  Seed: CKKLKIFAMPMQDIKM (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKX

SEQ ID NO: 349575 - protein, 17 aa, Artificial Sequence
  Description of Artificial Sequence: Synthetic peptide
  Seed: CKKLKIFAMPMQDIKMI (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMI

SEQ ID NO: 349576 - protein, 17 aa, Artificial Sequence
  Description of Artificial Sequence: Synthetic peptide
  Seed: CKKLKIFAMPMQDIKMI (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMI

SEQ ID NO: 349577 - protein, 17 aa, Artificial Sequence
  Description of Artificial Sequence: Synthetic peptide
  Seed: CKKLKIFAMPMQDIKMI (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMI

SEQ ID NO: 349578 - protein, 17 aa, Artificial Sequence
  Description of Artificial Sequence: Synthetic peptide
  Seed: CKKLKIFAMPMQDIKMI (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXI

SEQ ID NO: 349579 - protein, 18 aa, Artificial Sequence
  Description of Artificial Sequence: Synthetic peptide
  Seed: CKKLKIFAMPMQDIKMIL (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMIL

SEQ ID NO: 349580 - protein, 18 aa, Artificial Sequence
  Description of Artificial Sequence: Synthetic peptide
  Seed: CKKLKIFAMPMQDIKMIL (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMIL

SEQ ID NO: 349581 - protein, 18 aa, Artificial Sequence
  Description of Artificial Sequence: Synthetic peptide
  Seed: CKKLKIFAMPMQDIKMIL (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMIL

SEQ ID NO: 349582 - protein, 18 aa, Artificial Sequence
  Description of Artificial Sequence: Synthetic peptide
  Seed: CKKLKIFAMPMQDIKMIL (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXIL

SEQ ID NO: 349583 - protein, 19 aa, Artificial Sequence
  Description of Artificial Sequence: Synthetic peptide
  Seed: CKKLKIFAMPMQDIKMILK (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILK

SEQ ID NO: 349584 - protein, 19 aa, Artificial Sequence
  Description of Artificial Sequence: Synthetic peptide
  Seed: CKKLKIFAMPMQDIKMILK (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILK

SEQ ID NO: 349585 - protein, 19 aa, Artificial Sequence
  Description of Artificial Sequence: Synthetic peptide
  Seed: CKKLKIFAMPMQDIKMILK (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILK

SEQ ID NO: 349586 - protein, 19 aa, Artificial Sequence
  Description of Artificial Sequence: Synthetic peptide
  Seed: CKKLKIFAMPMQDIKMILK (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILK

SEQ ID NO: 349587 - protein, 20 aa, Artificial Sequence
  Description of Artificial Sequence: Synthetic peptide
  Seed: CKKLKIFAMPMQDIKMILKM (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKM

SEQ ID NO: 349588 - protein, 20 aa, Artificial Sequence
  Description of Artificial Sequence: Synthetic peptide
  Seed: CKKLKIFAMPMQDIKMILKM (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKM

SEQ ID NO: 349589 - protein, 20 aa, Artificial Sequence
  Description of Artificial Sequence: Synthetic peptide
  Seed: CKKLKIFAMPMQDIKMILKM (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKM

SEQ ID NO: 349590 - protein, 20 aa, Artificial Sequence
  Description of Artificial Sequence: Synthetic peptide
  Seed: CKKLKIFAMPMQDIKMILKM (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKM

SEQ ID NO: 349591 - protein, 21 aa, Artificial Sequence
  Description of Artificial Sequence: Synthetic peptide
  Seed: CKKLKIFAMPMQDIKMILKMV (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKMV

SEQ ID NO: 349592 - protein, 21 aa, Artificial Sequence
  Description of Artificial Sequence: Synthetic peptide
  Seed: CKKLKIFAMPMQDIKMILKMV (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKMV

SEQ ID NO: 349593 - protein, 21 aa, Artificial Sequence
  Description of Artificial Sequence: Synthetic peptide
  Seed: CKKLKIFAMPMQDIKMILKMV (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKMV

SEQ ID NO: 349594 - protein, 21 aa, Artificial Sequence
  Description of Artificial Sequence: Synthetic peptide
  Seed: CKKLKIFAMPMQDIKMILKMV (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKMV

SEQ ID NO: 349595 - protein, 22 aa, Artificial Sequence
  Description of Artificial Sequence: Synthetic peptide
  Seed: CKKLKIFAMPMQDIKMILKMVQ (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKMVQ

SEQ ID NO: 349596 - protein, 22 aa, Artificial Sequence
  Description of Artificial Sequence: Synthetic peptide
  Seed: CKKLKIFAMPMQDIKMILKMVQ (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKMVQ

SEQ ID NO: 349597 - protein, 22 aa, Artificial Sequence
  Description of Artificial Sequence: Synthetic peptide
  Seed: CKKLKIFAMPMQDIKMILKMVQ (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKMVQ

SEQ ID NO: 349598 - protein, 22 aa, Artificial Sequence
  Description of Artificial Sequence: Synthetic peptide
  Seed: CKKLKIFAMPMQDIKMILKMVQ (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKMVQ

SEQ ID NO: 349599 - protein, 22 aa, Artificial Sequence
  Description of Artificial Sequence: Synthetic peptide
  Seed: CKKLKIFAMPMQDIKMILKMVQ (PRAME_HUMAN)
  Core: IKMILKMVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFAMPMQDXKMXLXMVX

SEQ ID NO: 349600 - protein, 23 aa, Artificial Sequence
  Description of Artificial Sequence: Synthetic peptide
  Seed: CKKLKIFAMPMQDIKMILKMVQL (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKMVQL

SEQ ID NO: 349601 - protein, 23 aa, Artificial Sequence
  Description of Artificial Sequence: Synthetic peptide
  Seed: CKKLKIFAMPMQDIKMILKMVQL (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKMVQL

SEQ ID NO: 349602 - protein, 23 aa, Artificial Sequence
  Description of Artificial Sequence: Synthetic peptide
  Seed: CKKLKIFAMPMQDIKMILKMVQL (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKMVQL

SEQ ID NO: 349603 - protein, 23 aa, Artificial Sequence
  Description of Artificial Sequence: Synthetic peptide
  Seed: CKKLKIFAMPMQDIKMILKMVQL (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKMVQL

SEQ ID NO: 349604 - protein, 23 aa, Artificial Sequence
  Description of Artificial Sequence: Synthetic peptide
  Seed: CKKLKIFAMPMQDIKMILKMVQL (PRAME_HUMAN)
  Core: IKMILKMVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFAMPMQDXKMXLXMVXL

SEQ ID NO: 349605 - protein, 24 aa, Artificial Sequence
  Description of Artificial Sequence: Synthetic peptide
  Seed: CKKLKIFAMPMQDIKMILKMVQLD (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKMVQLD

SEQ ID NO: 349606 - protein, 24 aa, Artificial Sequence
  Description of Artificial Sequence: Synthetic peptide
  Seed: CKKLKIFAMPMQDIKMILKMVQLD (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKMVQLD

SEQ ID NO: 349607 - protein, 24 aa, Artificial Sequence
  Description of Artificial Sequence: Synthetic peptide
  Seed: CKKLKIFAMPMQDIKMILKMVQLD (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKMVQLD

SEQ ID NO: 349608 - protein, 24 aa, Artificial Sequence
  Description of Artificial Sequence: Synthetic peptide
  Seed: CKKLKIFAMPMQDIKMILKMVQLD (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKMVQLD

SEQ ID NO: 349609 - protein, 24 aa, Artificial Sequence
  Description of Artificial Sequence: Synthetic peptide
  Seed: CKKLKIFAMPMQDIKMILKMVQLD (PRAME_HUMAN)
  Core: IKMILKMVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFAMPMQDXKMXLXMVXLD

SEQ ID NO: 349610 - protein, 25 aa, Artificial Sequence
  Description of Artificial Sequence: Synthetic peptide
  Seed: CKKLKIFAMPMQDIKMILKMVQLDS (PRAME_HUMAN)
  Core: LKIFAMPMQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CKKXKIXAXPMXDIKMILKMVQLDS

SEQ ID NO: 349611 - protein, 25 aa, Artificial Sequence
  Description of Artificial Sequence: Synthetic peptide
  Seed: CKKLKIFAMPMQDIKMILKMVQLDS (PRAME_HUMAN)
  Core: KIFAMPMQD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKKLXIFXMXMQXIKMILKMVQLDS

SEQ ID NO: 349612 - protein, 25 aa, Artificial Sequence
  Description of Artificial Sequence: Synthetic peptide
  Seed: CKKLKIFAMPMQDIKMILKMVQLDS (PRAME_HUMAN)
  Core: IFAMPMQDI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKXFAXPXQDXKMILKMVQLDS

SEQ ID NO: 349613 - protein, 25 aa, Artificial Sequence
  Description of Artificial Sequence: Synthetic peptide
  Seed: CKKLKIFAMPMQDIKMILKMVQLDS (PRAME_HUMAN)
  Core: AMPMQDIKM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFXMPXQXIKXILKMVQLDS

SEQ ID NO: 349614 - protein, 25 aa, Artificial Sequence
  Description of Artificial Sequence: Synthetic peptide
  Seed: CKKLKIFAMPMQDIKMILKMVQLDS (PRAME_HUMAN)
  Core: IKMILKMVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CKKLKIFAMPMQDXKMXLXMVXLDS

SEQ ID NO: 349615 - protein, 13 aa, Artificial Sequence
  Description of Artificial Sequence: Synthetic peptide
  Seed: CLPLGVLMKGQHL (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHX

SEQ ID NO: 349616 - protein, 14 aa, Artificial Sequence
  Description of Artificial Sequence: Synthetic peptide
  Seed: CLPLGVLMKGQHLH (PRAME_HUMAN)
  Core: LGVLMKGQH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CLPXGVXMXGQXLH

SEQ ID NO: 349617 - protein, 14 aa, Artificial Sequence
  Description of Artificial Sequence: Synthetic peptide
  Seed: CLPLGVLMKGQHLH (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXH

SEQ ID NO: 349618 - protein, 14 aa, Artificial Sequence
  Description of Artificial Sequence: Synthetic peptide
  Seed: CLPLGVLMKGQHLH (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLX

SEQ ID NO: 349619 - protein, 15 aa, Artificial Sequence
  Description of Artificial Sequence: Synthetic peptide
  Seed: CLPLGVLMKGQHLHL (PRAME_HUMAN)
  Core: LGVLMKGQH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CLPXGVXMXGQXLHL

SEQ ID NO: 349620 - protein, 15 aa, Artificial Sequence
  Description of Artificial Sequence: Synthetic peptide
  Seed: CLPLGVLMKGQHLHL (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHL

SEQ ID NO: 349621 - protein, 15 aa, Artificial Sequence
  Description of Artificial Sequence: Synthetic peptide
  Seed: CLPLGVLMKGQHLHL (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXL

SEQ ID NO: 349622 - protein, 16 aa, Artificial Sequence
  Description of Artificial Sequence: Synthetic peptide
  Seed: CLPLGVLMKGQHLHLE (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLE

SEQ ID NO: 349623 - protein, 16 aa, Artificial Sequence
  Description of Artificial Sequence: Synthetic peptide
  Seed: CLPLGVLMKGQHLHLE (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLE

SEQ ID NO: 349624 - protein, 16 aa, Artificial Sequence
  Description of Artificial Sequence: Synthetic peptide
  Seed: CLPLGVLMKGQHLHLE (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLX

SEQ ID NO: 349625 - protein, 17 aa, Artificial Sequence
  Description of Artificial Sequence: Synthetic peptide
  Seed: CLPLGVLMKGQHLHLET (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLET

SEQ ID NO: 349626 - protein, 17 aa, Artificial Sequence
  Description of Artificial Sequence: Synthetic peptide
  Seed: CLPLGVLMKGQHLHLET (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLET

SEQ ID NO: 349627 - protein, 17 aa, Artificial Sequence
  Description of Artificial Sequence: Synthetic peptide
  Seed: CLPLGVLMKGQHLHLET (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXT

SEQ ID NO: 349628 - protein, 18 aa, Artificial Sequence
  Description of Artificial Sequence: Synthetic peptide
  Seed: CLPLGVLMKGQHLHLETF (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETF

SEQ ID NO: 349629 - protein, 18 aa, Artificial Sequence
  Description of Artificial Sequence: Synthetic peptide
  Seed: CLPLGVLMKGQHLHLETF (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETF

SEQ ID NO: 349630 - protein, 18 aa, Artificial Sequence
  Description of Artificial Sequence: Synthetic peptide
  Seed: CLPLGVLMKGQHLHLETF (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTF

SEQ ID NO: 349631 - protein, 19 aa, Artificial Sequence
  Description of Artificial Sequence: Synthetic peptide
  Seed: CLPLGVLMKGQHLHLETFK (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFK

SEQ ID NO: 349632 - protein, 19 aa, Artificial Sequence
  Description of Artificial Sequence: Synthetic peptide
  Seed: CLPLGVLMKGQHLHLETFK (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFK

SEQ ID NO: 349633 - protein, 19 aa, Artificial Sequence
  Description of Artificial Sequence: Synthetic peptide
  Seed: CLPLGVLMKGQHLHLETFK (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFK

SEQ ID NO: 349634 - protein, 20 aa, Artificial Sequence
  Description of Artificial Sequence: Synthetic peptide
  Seed: CLPLGVLMKGQHLHLETFKA (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKA

SEQ ID NO: 349635 - protein, 20 aa, Artificial Sequence
  Description of Artificial Sequence: Synthetic peptide
  Seed: CLPLGVLMKGQHLHLETFKA (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKA

SEQ ID NO: 349636 - protein, 20 aa, Artificial Sequence
  Description of Artificial Sequence: Synthetic peptide
  Seed: CLPLGVLMKGQHLHLETFKA (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKA

SEQ ID NO: 349637 - protein, 21 aa, Artificial Sequence
  Description of Artificial Sequence: Synthetic peptide
  Seed: CLPLGVLMKGQHLHLETFKAV (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKAV

SEQ ID NO: 349638 - protein, 21 aa, Artificial Sequence
  Description of Artificial Sequence: Synthetic peptide
  Seed: CLPLGVLMKGQHLHLETFKAV (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKAV

SEQ ID NO: 349639 - protein, 21 aa, Artificial Sequence
  Description of Artificial Sequence: Synthetic peptide
  Seed: CLPLGVLMKGQHLHLETFKAV (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKAV

SEQ ID NO: 349640 - protein, 21 aa, Artificial Sequence
  Description of Artificial Sequence: Synthetic peptide
  Seed: CLPLGVLMKGQHLHLETFKAV (PRAME_HUMAN)
  Core: LHLETFKAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHXHLXTXKAX

SEQ ID NO: 349641 - protein, 22 aa, Artificial Sequence
  Description of Artificial Sequence: Synthetic peptide
  Seed: CLPLGVLMKGQHLHLETFKAVL (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKAVL

SEQ ID NO: 349642 - protein, 22 aa, Artificial Sequence
  Description of Artificial Sequence: Synthetic peptide
  Seed: CLPLGVLMKGQHLHLETFKAVL (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKAVL

SEQ ID NO: 349643 - protein, 22 aa, Artificial Sequence
  Description of Artificial Sequence: Synthetic peptide
  Seed: CLPLGVLMKGQHLHLETFKAVL (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKAVL

SEQ ID NO: 349644 - protein, 22 aa, Artificial Sequence
  Description of Artificial Sequence: Synthetic peptide
  Seed: CLPLGVLMKGQHLHLETFKAVL (PRAME_HUMAN)
  Core: HLHLETFKA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQXLHXEXFKXVL

SEQ ID NO: 349645 - protein, 22 aa, Artificial Sequence
  Description of Artificial Sequence: Synthetic peptide
  Seed: CLPLGVLMKGQHLHLETFKAVL (PRAME_HUMAN)
  Core: LHLETFKAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHXHLXTXKAXL

SEQ ID NO: 349646 - protein, 23 aa, Artificial Sequence
  Description of Artificial Sequence: Synthetic peptide
  Seed: CLPLGVLMKGQHLHLETFKAVLD (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKAVLD

SEQ ID NO: 349647 - protein, 23 aa, Artificial Sequence
  Description of Artificial Sequence: Synthetic peptide
  Seed: CLPLGVLMKGQHLHLETFKAVLD (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKAVLD

SEQ ID NO: 349648 - protein, 23 aa, Artificial Sequence
  Description of Artificial Sequence: Synthetic peptide
  Seed: CLPLGVLMKGQHLHLETFKAVLD (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKAVLD

SEQ ID NO: 349649 - protein, 23 aa, Artificial Sequence
  Description of Artificial Sequence: Synthetic peptide
  Seed: CLPLGVLMKGQHLHLETFKAVLD (PRAME_HUMAN)
  Core: HLHLETFKA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQXLHXEXFKXVLD

SEQ ID NO: 349650 - protein, 23 aa, Artificial Sequence
  Description of Artificial Sequence: Synthetic peptide
  Seed: CLPLGVLMKGQHLHLETFKAVLD (PRAME_HUMAN)
  Core: LHLETFKAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHXHLXTXKAXLD

SEQ ID NO: 349651 - protein, 24 aa, Artificial Sequence
  Description of Artificial Sequence: Synthetic peptide
  Seed: CLPLGVLMKGQHLHLETFKAVLDG (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKAVLDG

SEQ ID NO: 349652 - protein, 24 aa, Artificial Sequence
  Description of Artificial Sequence: Synthetic peptide
  Seed: CLPLGVLMKGQHLHLETFKAVLDG (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKAVLDG

SEQ ID NO: 349653 - protein, 24 aa, Artificial Sequence
  Description of Artificial Sequence: Synthetic peptide
  Seed: CLPLGVLMKGQHLHLETFKAVLDG (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKAVLDG

SEQ ID NO: 349654 - protein, 24 aa, Artificial Sequence
  Description of Artificial Sequence: Synthetic peptide
  Seed: CLPLGVLMKGQHLHLETFKAVLDG (PRAME_HUMAN)
  Core: HLHLETFKA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQXLHXEXFKXVLDG

SEQ ID NO: 349655 - protein, 24 aa, Artificial Sequence
  Description of Artificial Sequence: Synthetic peptide
  Seed: CLPLGVLMKGQHLHLETFKAVLDG (PRAME_HUMAN)
  Core: LHLETFKAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHXHLXTXKAXLDG

SEQ ID NO: 349656 - protein, 24 aa, Artificial Sequence
  Description of Artificial Sequence: Synthetic peptide
  Seed: CLPLGVLMKGQHLHLETFKAVLDG (PRAME_HUMAN)
  Core: LETFKAVLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHLHXETXKXVLXG

SEQ ID NO: 349657 - protein, 25 aa, Artificial Sequence
  Description of Artificial Sequence: Synthetic peptide
  Seed: CLPLGVLMKGQHLHLETFKAVLDGL (PRAME_HUMAN)
  Core: GVLMKGQHL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLPLXVLXKXQHXHLETFKAVLDGL

SEQ ID NO: 349658 - protein, 25 aa, Artificial Sequence
  Description of Artificial Sequence: Synthetic peptide
  Seed: CLPLGVLMKGQHLHLETFKAVLDGL (PRAME_HUMAN)
  Core: VLMKGQHLH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGXLMXGXHLXLETFKAVLDGL

SEQ ID NO: 349659 - protein, 25 aa, Artificial Sequence
  Description of Artificial Sequence: Synthetic peptide
  Seed: CLPLGVLMKGQHLHLETFKAVLDGL (PRAME_HUMAN)
  Core: MKGQHLHLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLXKGXHXHLXTFKAVLDGL

SEQ ID NO: 349660 - protein, 25 aa, Artificial Sequence
  Description of Artificial Sequence: Synthetic peptide
  Seed: CLPLGVLMKGQHLHLETFKAVLDGL (PRAME_HUMAN)
  Core: HLHLETFKA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQXLHXEXFKXVLDGL

SEQ ID NO: 349661 - protein, 25 aa, Artificial Sequence
  Description of Artificial Sequence: Synthetic peptide
  Seed: CLPLGVLMKGQHLHLETFKAVLDGL (PRAME_HUMAN)
  Core: LHLETFKAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHXHLXTXKAXLDGL

SEQ ID NO: 349662 - protein, 25 aa, Artificial Sequence
  Description of Artificial Sequence: Synthetic peptide
  Seed: CLPLGVLMKGQHLHLETFKAVLDGL (PRAME_HUMAN)
  Core: LETFKAVLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CLPLGVLMKGQHLHXETXKXVLXGL

SEQ ID NO: 349663 - protein, 13 aa, Artificial Sequence
  Description of Artificial Sequence: Synthetic peptide
  Seed: CLQALYVDSLFFL (PRAME_HUMAN)
  Core: LQALYVDSL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
CXQAXYXDSXFFL

SEQ ID NO: 349664 - protein, 13 aa, Artificial Sequence
  Description of Artificial Sequence: Synthetic peptide
  Seed: CLQALYVDSLFFL (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFL

SEQ ID NO: 349665 - protein, 13 aa, Artificial Sequence
  Description of Artificial Sequence: Synthetic peptide
  Seed: CLQALYVDSLFFL (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFX

SEQ ID NO: 349666 - protein, 14 aa, Artificial Sequence
  Description of Artificial Sequence: Synthetic peptide
  Seed: CLQALYVDSLFFLR (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFLR

SEQ ID NO: 349667 - protein, 14 aa, Artificial Sequence
  Description of Artificial Sequence: Synthetic peptide
  Seed: CLQALYVDSLFFLR (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXR

SEQ ID NO: 349668 - protein, 14 aa, Artificial Sequence
  Description of Artificial Sequence: Synthetic peptide
  Seed: CLQALYVDSLFFLR (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLX

SEQ ID NO: 349669 - protein, 15 aa, Artificial Sequence
  Description of Artificial Sequence: Synthetic peptide
  Seed: CLQALYVDSLFFLRG (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFLRG

SEQ ID NO: 349670 - protein, 15 aa, Artificial Sequence
  Description of Artificial Sequence: Synthetic peptide
  Seed: CLQALYVDSLFFLRG (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRG

SEQ ID NO: 349671 - protein, 15 aa, Artificial Sequence
  Description of Artificial Sequence: Synthetic peptide
  Seed: CLQALYVDSLFFLRG (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXG

SEQ ID NO: 349672 - protein, 16 aa, Artificial Sequence
  Description of Artificial Sequence: Synthetic peptide
  Seed: CLQALYVDSLFFLRGR (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFLRGR

SEQ ID NO: 349673 - protein, 16 aa, Artificial Sequence
  Description of Artificial Sequence: Synthetic peptide
  Seed: CLQALYVDSLFFLRGR (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGR

SEQ ID NO: 349674 - protein, 16 aa, Artificial Sequence
  Description of Artificial Sequence: Synthetic peptide
  Seed: CLQALYVDSLFFLRGR (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGR

SEQ ID NO: 349675 - protein, 16 aa, Artificial Sequence
  Description of Artificial Sequence: Synthetic peptide
  Seed: CLQALYVDSLFFLRGR (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXR

SEQ ID NO: 349676 - protein, 17 aa, Artificial Sequence
  Description of Artificial Sequence: Synthetic peptide
  Seed: CLQALYVDSLFFLRGRL (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFLRGRL

SEQ ID NO: 349677 - protein, 17 aa, Artificial Sequence
  Description of Artificial Sequence: Synthetic peptide
  Seed: CLQALYVDSLFFLRGRL (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRL

SEQ ID NO: 349678 - protein, 17 aa, Artificial Sequence
  Description of Artificial Sequence: Synthetic peptide
  Seed: CLQALYVDSLFFLRGRL (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRL

SEQ ID NO: 349679 - protein, 17 aa, Artificial Sequence
  Description of Artificial Sequence: Synthetic peptide
  Seed: CLQALYVDSLFFLRGRL (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRL

SEQ ID NO: 349680 - protein, 18 aa, Artificial Sequence
  Description of Artificial Sequence: Synthetic peptide
  Seed: CLQALYVDSLFFLRGRLD (PRAME_HUMAN)
  Core: QALYVDSLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CLXALXVXSLXFLRGRLD

SEQ ID NO: 349681 - protein, 18 aa, Artificial Sequence
  Description of Artificial Sequence: Synthetic peptide
  Seed: CLQALYVDSLFFLRGRLD (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLD

SEQ ID NO: 349682 - protein, 18 aa, Artificial Sequence
  Description of Artificial Sequence: Synthetic peptide
  Seed: CLQALYVDSLFFLRGRLD (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLD

SEQ ID NO: 349683 - protein, 18 aa, Artificial Sequence
  Description of Artificial Sequence: Synthetic peptide
  Seed: CLQALYVDSLFFLRGRLD (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLD

SEQ ID NO: 349684 - protein, 18 aa, Artificial Sequence
  Description of Artificial Sequence: Synthetic peptide
  Seed: CLQALYVDSLFFLRGRLD (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLX

SEQ ID NO: 349685 - protein, 19 aa, Artificial Sequence
  Description of Artificial Sequence: Synthetic peptide
  Seed: CLQALYVDSLFFLRGRLDQ (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQ

SEQ ID NO: 349686 - protein, 19 aa, Artificial Sequence
  Description of Artificial Sequence: Synthetic peptide
  Seed: CLQALYVDSLFFLRGRLDQ (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQ

SEQ ID NO: 349687 - protein, 19 aa, Artificial Sequence
  Description of Artificial Sequence: Synthetic peptide
  Seed: CLQALYVDSLFFLRGRLDQ (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQ

SEQ ID NO: 349688 - protein, 19 aa, Artificial Sequence
  Description of Artificial Sequence: Synthetic peptide
  Seed: CLQALYVDSLFFLRGRLDQ (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQ

SEQ ID NO: 349689 - protein, 20 aa, Artificial Sequence
  Description of Artificial Sequence: Synthetic peptide
  Seed: CLQALYVDSLFFLRGRLDQL (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQL

SEQ ID NO: 349690 - protein, 20 aa, Artificial Sequence
  Description of Artificial Sequence: Synthetic peptide
  Seed: CLQALYVDSLFFLRGRLDQL (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQL

SEQ ID NO: 349691 - protein, 20 aa, Artificial Sequence
  Description of Artificial Sequence: Synthetic peptide
  Seed: CLQALYVDSLFFLRGRLDQL (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQL

SEQ ID NO: 349692 - protein, 20 aa, Artificial Sequence
  Description of Artificial Sequence: Synthetic peptide
  Seed: CLQALYVDSLFFLRGRLDQL (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQL

SEQ ID NO: 349693 - protein, 21 aa, Artificial Sequence
  Description of Artificial Sequence: Synthetic peptide
  Seed: CLQALYVDSLFFLRGRLDQLL (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQLL

SEQ ID NO: 349694 - protein, 21 aa, Artificial Sequence
  Description of Artificial Sequence: Synthetic peptide
  Seed: CLQALYVDSLFFLRGRLDQLL (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQLL

SEQ ID NO: 349695 - protein, 21 aa, Artificial Sequence
  Description of Artificial Sequence: Synthetic peptide
  Seed: CLQALYVDSLFFLRGRLDQLL (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQLL

SEQ ID NO: 349696 - protein, 21 aa, Artificial Sequence
  Description of Artificial Sequence: Synthetic peptide
  Seed: CLQALYVDSLFFLRGRLDQLL (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQLL

SEQ ID NO: 349697 - protein, 22 aa, Artificial Sequence
  Description of Artificial Sequence: Synthetic peptide
  Seed: CLQALYVDSLFFLRGRLDQLLR (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQLLR

SEQ ID NO: 349698 - protein, 22 aa, Artificial Sequence
  Description of Artificial Sequence: Synthetic peptide
  Seed: CLQALYVDSLFFLRGRLDQLLR (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQLLR

SEQ ID NO: 349699 - protein, 22 aa, Artificial Sequence
  Description of Artificial Sequence: Synthetic peptide
  Seed: CLQALYVDSLFFLRGRLDQLLR (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQLLR

SEQ ID NO: 349700 - protein, 22 aa, Artificial Sequence
  Description of Artificial Sequence: Synthetic peptide
  Seed: CLQALYVDSLFFLRGRLDQLLR (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQLLR

SEQ ID NO: 349701 - protein, 22 aa, Artificial Sequence
  Description of Artificial Sequence: Synthetic peptide
  Seed: CLQALYVDSLFFLRGRLDQLLR (PRAME_HUMAN)
  Core: FFLRGRLDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLXFLXGXLDXLLR

SEQ ID NO: 349702 - protein, 22 aa, Artificial Sequence
  Description of Artificial Sequence: Synthetic peptide
  Seed: CLQALYVDSLFFLRGRLDQLLR (PRAME_HUMAN)
  Core: LRGRLDQLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFFXRGXLXQLXR

SEQ ID NO: 349703 - protein, 23 aa, Artificial Sequence
  Description of Artificial Sequence: Synthetic peptide
  Seed: CLQALYVDSLFFLRGRLDQLLRH (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQLLRH

SEQ ID NO: 349704 - protein, 23 aa, Artificial Sequence
  Description of Artificial Sequence: Synthetic peptide
  Seed: CLQALYVDSLFFLRGRLDQLLRH (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQLLRH

SEQ ID NO: 349705 - protein, 23 aa, Artificial Sequence
  Description of Artificial Sequence: Synthetic peptide
  Seed: CLQALYVDSLFFLRGRLDQLLRH (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQLLRH

SEQ ID NO: 349706 - protein, 23 aa, Artificial Sequence
  Description of Artificial Sequence: Synthetic peptide
  Seed: CLQALYVDSLFFLRGRLDQLLRH (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQLLRH

SEQ ID NO: 349707 - protein, 23 aa, Artificial Sequence
  Description of Artificial Sequence: Synthetic peptide
  Seed: CLQALYVDSLFFLRGRLDQLLRH (PRAME_HUMAN)
  Core: FFLRGRLDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLXFLXGXLDXLLRH

SEQ ID NO: 349708 - protein, 23 aa, Artificial Sequence
  Description of Artificial Sequence: Synthetic peptide
  Seed: CLQALYVDSLFFLRGRLDQLLRH (PRAME_HUMAN)
  Core: FLRGRLDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFXLRXRXDQXLRH

SEQ ID NO: 349709 - protein, 23 aa, Artificial Sequence
  Description of Artificial Sequence: Synthetic peptide
  Seed: CLQALYVDSLFFLRGRLDQLLRH (PRAME_HUMAN)
  Core: LRGRLDQLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFFXRGXLXQLXRH

SEQ ID NO: 349710 - protein, 24 aa, Artificial Sequence
  Description of Artificial Sequence: Synthetic peptide
  Seed: CLQALYVDSLFFLRGRLDQLLRHV (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQLLRHV

SEQ ID NO: 349711 - protein, 24 aa, Artificial Sequence
  Description of Artificial Sequence: Synthetic peptide
  Seed: CLQALYVDSLFFLRGRLDQLLRHV (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQLLRHV

SEQ ID NO: 349712 - protein, 24 aa, Artificial Sequence
  Description of Artificial Sequence: Synthetic peptide
  Seed: CLQALYVDSLFFLRGRLDQLLRHV (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQLLRHV

SEQ ID NO: 349713 - protein, 24 aa, Artificial Sequence
  Description of Artificial Sequence: Synthetic peptide
  Seed: CLQALYVDSLFFLRGRLDQLLRHV (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQLLRHV

SEQ ID NO: 349714 - protein, 24 aa, Artificial Sequence
  Description of Artificial Sequence: Synthetic peptide
  Seed: CLQALYVDSLFFLRGRLDQLLRHV (PRAME_HUMAN)
  Core: FFLRGRLDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLXFLXGXLDXLLRHV

SEQ ID NO: 349715 - protein, 24 aa, Artificial Sequence
  Description of Artificial Sequence: Synthetic peptide
  Seed: CLQALYVDSLFFLRGRLDQLLRHV (PRAME_HUMAN)
  Core: FLRGRLDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFXLRXRXDQXLRHV

SEQ ID NO: 349716 - protein, 24 aa, Artificial Sequence
  Description of Artificial Sequence: Synthetic peptide
  Seed: CLQALYVDSLFFLRGRLDQLLRHV (PRAME_HUMAN)
  Core: LRGRLDQLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFFXRGXLXQLXRHV

SEQ ID NO: 349717 - protein, 25 aa, Artificial Sequence
  Description of Artificial Sequence: Synthetic peptide
  Seed: CLQALYVDSLFFLRGRLDQLLRHVM (PRAME_HUMAN)
  Core: LYVDSLFFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLQAXYVXSXFFXRGRLDQLLRHVM

SEQ ID NO: 349718 - protein, 25 aa, Artificial Sequence
  Description of Artificial Sequence: Synthetic peptide
  Seed: CLQALYVDSLFFLRGRLDQLLRHVM (PRAME_HUMAN)
  Core: YVDSLFFLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLQALXVDXLXFLXGRLDQLLRHVM

SEQ ID NO: 349719 - protein, 25 aa, Artificial Sequence
  Description of Artificial Sequence: Synthetic peptide
  Seed: CLQALYVDSLFFLRGRLDQLLRHVM (PRAME_HUMAN)
  Core: VDSLFFLRG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYXDSXFXLRXRLDQLLRHVM

SEQ ID NO: 349720 - protein, 25 aa, Artificial Sequence
  Description of Artificial Sequence: Synthetic peptide
  Seed: CLQALYVDSLFFLRGRLDQLLRHVM (PRAME_HUMAN)
  Core: LFFLRGRLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSXFFXRXRLXQLLRHVM

SEQ ID NO: 349721 - protein, 25 aa, Artificial Sequence
  Description of Artificial Sequence: Synthetic peptide
  Seed: CLQALYVDSLFFLRGRLDQLLRHVM (PRAME_HUMAN)
  Core: FFLRGRLDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLXFLXGXLDXLLRHVM

SEQ ID NO: 349722 - protein, 25 aa, Artificial Sequence
  Description of Artificial Sequence: Synthetic peptide
  Seed: CLQALYVDSLFFLRGRLDQLLRHVM (PRAME_HUMAN)
  Core: FLRGRLDQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFXLRXRXDQXLRHVM

SEQ ID NO: 349723 - protein, 25 aa, Artificial Sequence
  Description of Artificial Sequence: Synthetic peptide
  Seed: CLQALYVDSLFFLRGRLDQLLRHVM (PRAME_HUMAN)
  Core: LRGRLDQLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFFXRGXLXQLXRHVM

SEQ ID NO: 349724 - protein, 25 aa, Artificial Sequence
  Description of Artificial Sequence: Synthetic peptide
  Seed: CLQALYVDSLFFLRGRLDQLLRHVM (PRAME_HUMAN)
  Core: RLDQLLRHV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
CLQALYVDSLFFLRGXLDXLXRHXM

SEQ ID NO: 349725 - protein, 23 aa, Artificial Sequence
  Description of Artificial Sequence: Synthetic peptide
  Seed: CPHCGDRTFYDPEPILCPCFMPN (PRAME_HUMAN)
  Core: RTFYDPEPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CPHCGDXTFXDXEPXLCPCFMPN

SEQ ID NO: 349726 - protein, 17 aa, Artificial Sequence
  Description of Artificial Sequence: Synthetic peptide
  Seed: CRLSEGDVMHLSQSPSV (PRAME_HUMAN)
  Core: SEGDVMHLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CRLXEGXVXHLXQSPSV

SEQ ID NO: 349727 - protein, 19 aa, Artificial Sequence
  Description of Artificial Sequence: Synthetic peptide
  Seed: CRLSEGDVMHLSQSPSVSQ (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQ

SEQ ID NO: 349728 - protein, 20 aa, Artificial Sequence
  Description of Artificial Sequence: Synthetic peptide
  Seed: CRLSEGDVMHLSQSPSVSQL (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQL

SEQ ID NO: 349729 - protein, 20 aa, Artificial Sequence
  Description of Artificial Sequence: Synthetic peptide
  Seed: CRLSEGDVMHLSQSPSVSQL (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQL

SEQ ID NO: 349730 - protein, 21 aa, Artificial Sequence
  Description of Artificial Sequence: Synthetic peptide
  Seed: CRLSEGDVMHLSQSPSVSQLS (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQLS

SEQ ID NO: 349731 - protein, 21 aa, Artificial Sequence
  Description of Artificial Sequence: Synthetic peptide
  Seed: CRLSEGDVMHLSQSPSVSQLS (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQLS

SEQ ID NO: 349732 - protein, 22 aa, Artificial Sequence
  Description of Artificial Sequence: Synthetic peptide
  Seed: CRLSEGDVMHLSQSPSVSQLSV (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQLSV

SEQ ID NO: 349733 - protein, 22 aa, Artificial Sequence
  Description of Artificial Sequence: Synthetic peptide
  Seed: CRLSEGDVMHLSQSPSVSQLSV (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQLSV

SEQ ID NO: 349734 - protein, 22 aa, Artificial Sequence
  Description of Artificial Sequence: Synthetic peptide
  Seed: CRLSEGDVMHLSQSPSVSQLSV (PRAME_HUMAN)
  Core: QSPSVSQLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVMHLSXSPXVXQLXV

SEQ ID NO: 349735 - protein, 23 aa, Artificial Sequence
  Description of Artificial Sequence: Synthetic peptide
  Seed: CRLSEGDVMHLSQSPSVSQLSVL (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQLSVL

SEQ ID NO: 349736 - protein, 23 aa, Artificial Sequence
  Description of Artificial Sequence: Synthetic peptide
  Seed: CRLSEGDVMHLSQSPSVSQLSVL (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQLSVL

SEQ ID NO: 349737 - protein, 23 aa, Artificial Sequence
  Description of Artificial Sequence: Synthetic peptide
  Seed: CRLSEGDVMHLSQSPSVSQLSVL (PRAME_HUMAN)
  Core: QSPSVSQLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVMHLSXSPXVXQLXVL

SEQ ID NO: 349738 - protein, 24 aa, Artificial Sequence
  Description of Artificial Sequence: Synthetic peptide
  Seed: CRLSEGDVMHLSQSPSVSQLSVLS (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQLSVLS

SEQ ID NO: 349739 - protein, 24 aa, Artificial Sequence
  Description of Artificial Sequence: Synthetic peptide
  Seed: CRLSEGDVMHLSQSPSVSQLSVLS (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQLSVLS

SEQ ID NO: 349740 - protein, 24 aa, Artificial Sequence
  Description of Artificial Sequence: Synthetic peptide
  Seed: CRLSEGDVMHLSQSPSVSQLSVLS (PRAME_HUMAN)
  Core: QSPSVSQLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVMHLSXSPXVXQLXVLS

SEQ ID NO: 349741 - protein, 25 aa, Artificial Sequence
  Description of Artificial Sequence: Synthetic peptide
  Seed: CRLSEGDVMHLSQSPSVSQLSVLSL (PRAME_HUMAN)
  Core: VMHLSQSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDXMHXSXSPXVSQLSVLSL

SEQ ID NO: 349742 - protein, 25 aa, Artificial Sequence
  Description of Artificial Sequence: Synthetic peptide
  Seed: CRLSEGDVMHLSQSPSVSQLSVLSL (PRAME_HUMAN)
  Core: MHLSQSPSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVXHLXQXPSXSQLSVLSL

SEQ ID NO: 349743 - protein, 25 aa, Artificial Sequence
  Description of Artificial Sequence: Synthetic peptide
  Seed: CRLSEGDVMHLSQSPSVSQLSVLSL (PRAME_HUMAN)
  Core: QSPSVSQLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
CRLSEGDVMHLSXSPXVXQLXVLSL

SEQ ID NO: 349744 - protein, 14 aa, Artificial Sequence
  Description of Artificial Sequence: Synthetic peptide
  Seed: CSQLTTLSFYGNSI (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSI

SEQ ID NO: 349745 - protein, 14 aa, Artificial Sequence
  Description of Artificial Sequence: Synthetic peptide
  Seed: CSQLTTLSFYGNSI (PRAME_HUMAN)
  Core: TLSFYGNSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTXLSXYXNSX

SEQ ID NO: 349746 - protein, 15 aa, Artificial Sequence
  Description of Artificial Sequence: Synthetic peptide
  Seed: CSQLTTLSFYGNSIS (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSIS

SEQ ID NO: 349747 - protein, 15 aa, Artificial Sequence
  Description of Artificial Sequence: Synthetic peptide
  Seed: CSQLTTLSFYGNSIS (PRAME_HUMAN)
  Core: TLSFYGNSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTXLSXYXNSXS

SEQ ID NO: 349748 - protein, 15 aa, Artificial Sequence
  Description of Artificial Sequence: Synthetic peptide
  Seed: CSQLTTLSFYGNSIS (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIX

SEQ ID NO: 349749 - protein, 16 aa, Artificial Sequence
  Description of Artificial Sequence: Synthetic peptide
  Seed: CSQLTTLSFYGNSISI (PRAME_HUMAN)
  Core: QLTTLSFYG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CSXLTXLXFYXNSISI

SEQ ID NO: 349750 - protein, 16 aa, Artificial Sequence
  Description of Artificial Sequence: Synthetic peptide
  Seed: CSQLTTLSFYGNSISI (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISI

SEQ ID NO: 349751 - protein, 16 aa, Artificial Sequence
  Description of Artificial Sequence: Synthetic peptide
  Seed: CSQLTTLSFYGNSISI (PRAME_HUMAN)
  Core: TLSFYGNSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTXLSXYXNSXSI

SEQ ID NO: 349752 - protein, 16 aa, Artificial Sequence
  Description of Artificial Sequence: Synthetic peptide
  Seed: CSQLTTLSFYGNSISI (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXI

SEQ ID NO: 349753 - protein, 17 aa, Artificial Sequence
  Description of Artificial Sequence: Synthetic peptide
  Seed: CSQLTTLSFYGNSISIS (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISIS

SEQ ID NO: 349754 - protein, 17 aa, Artificial Sequence
  Description of Artificial Sequence: Synthetic peptide
  Seed: CSQLTTLSFYGNSISIS (PRAME_HUMAN)
  Core: TLSFYGNSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTXLSXYXNSXSIS

SEQ ID NO: 349755 - protein, 17 aa, Artificial Sequence
  Description of Artificial Sequence: Synthetic peptide
  Seed: CSQLTTLSFYGNSISIS (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXIS

SEQ ID NO: 349756 - protein, 17 aa, Artificial Sequence
  Description of Artificial Sequence: Synthetic peptide
  Seed: CSQLTTLSFYGNSISIS (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIX

SEQ ID NO: 349757 - protein, 18 aa, Artificial Sequence
  Description of Artificial Sequence: Synthetic peptide
  Seed: CSQLTTLSFYGNSISISA (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISA

SEQ ID NO: 349758 - protein, 18 aa, Artificial Sequence
  Description of Artificial Sequence: Synthetic peptide
  Seed: CSQLTTLSFYGNSISISA (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISA

SEQ ID NO: 349759 - protein, 18 aa, Artificial Sequence
  Description of Artificial Sequence: Synthetic peptide
  Seed: CSQLTTLSFYGNSISISA (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXA

SEQ ID NO: 349760 - protein, 19 aa, Artificial Sequence
  Description of Artificial Sequence: Synthetic peptide
  Seed: CSQLTTLSFYGNSISISAL (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISAL

SEQ ID NO: 349761 - protein, 19 aa, Artificial Sequence
  Description of Artificial Sequence: Synthetic peptide
  Seed: CSQLTTLSFYGNSISISAL (PRAME_HUMAN)
  Core: TLSFYGNSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTXLSXYXNSXSISAL

SEQ ID NO: 349762 - protein, 19 aa, Artificial Sequence
  Description of Artificial Sequence: Synthetic peptide
  Seed: CSQLTTLSFYGNSISISAL (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISAL

SEQ ID NO: 349763 - protein, 19 aa, Artificial Sequence
  Description of Artificial Sequence: Synthetic peptide
  Seed: CSQLTTLSFYGNSISISAL (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXAL

SEQ ID NO: 349764 - protein, 19 aa, Artificial Sequence
  Description of Artificial Sequence: Synthetic peptide
  Seed: CSQLTTLSFYGNSISISAL (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXL

SEQ ID NO: 349765 - protein, 20 aa, Artificial Sequence
  Description of Artificial Sequence: Synthetic peptide
  Seed: CSQLTTLSFYGNSISISALQ (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISALQ

SEQ ID NO: 349766 - protein, 20 aa, Artificial Sequence
  Description of Artificial Sequence: Synthetic peptide
  Seed: CSQLTTLSFYGNSISISALQ (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQ

SEQ ID NO: 349767 - protein, 20 aa, Artificial Sequence
  Description of Artificial Sequence: Synthetic peptide
  Seed: CSQLTTLSFYGNSISISALQ (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQ

SEQ ID NO: 349768 - protein, 20 aa, Artificial Sequence
  Description of Artificial Sequence: Synthetic peptide
  Seed: CSQLTTLSFYGNSISISALQ (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQ

SEQ ID NO: 349769 - protein, 20 aa, Artificial Sequence
  Description of Artificial Sequence: Synthetic peptide
  Seed: CSQLTTLSFYGNSISISALQ (PRAME_HUMAN)
  Core: GNSISISAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYXNSXSXSAXQ

SEQ ID NO: 349770 - protein, 21 aa, Artificial Sequence
  Description of Artificial Sequence: Synthetic peptide
  Seed: CSQLTTLSFYGNSISISALQS (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISALQS

SEQ ID NO: 349771 - protein, 21 aa, Artificial Sequence
  Description of Artificial Sequence: Synthetic peptide
  Seed: CSQLTTLSFYGNSISISALQS (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQS

SEQ ID NO: 349772 - protein, 21 aa, Artificial Sequence
  Description of Artificial Sequence: Synthetic peptide
  Seed: CSQLTTLSFYGNSISISALQS (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQS

SEQ ID NO: 349773 - protein, 21 aa, Artificial Sequence
  Description of Artificial Sequence: Synthetic peptide
  Seed: CSQLTTLSFYGNSISISALQS (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQS

SEQ ID NO: 349774 - protein, 22 aa, Artificial Sequence
  Description of Artificial Sequence: Synthetic peptide
  Seed: CSQLTTLSFYGNSISISALQSL (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISALQSL

SEQ ID NO: 349775 - protein, 22 aa, Artificial Sequence
  Description of Artificial Sequence: Synthetic peptide
  Seed: CSQLTTLSFYGNSISISALQSL (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQSL

SEQ ID NO: 349776 - protein, 22 aa, Artificial Sequence
  Description of Artificial Sequence: Synthetic peptide
  Seed: CSQLTTLSFYGNSISISALQSL (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQSL

SEQ ID NO: 349777 - protein, 22 aa, Artificial Sequence
  Description of Artificial Sequence: Synthetic peptide
  Seed: CSQLTTLSFYGNSISISALQSL (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQSL

SEQ ID NO: 349778 - protein, 22 aa, Artificial Sequence
  Description of Artificial Sequence: Synthetic peptide
  Seed: CSQLTTLSFYGNSISISALQSL (PRAME_HUMAN)
  Core: ISISALQSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYGNSXSIXAXQSX

SEQ ID NO: 349779 - protein, 23 aa, Artificial Sequence
  Description of Artificial Sequence: Synthetic peptide
  Seed: CSQLTTLSFYGNSISISALQSLL (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISALQSLL

SEQ ID NO: 349780 - protein, 23 aa, Artificial Sequence
  Description of Artificial Sequence: Synthetic peptide
  Seed: CSQLTTLSFYGNSISISALQSLL (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQSLL

SEQ ID NO: 349781 - protein, 23 aa, Artificial Sequence
  Description of Artificial Sequence: Synthetic peptide
  Seed: CSQLTTLSFYGNSISISALQSLL (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQSLL

SEQ ID NO: 349782 - protein, 23 aa, Artificial Sequence
  Description of Artificial Sequence: Synthetic peptide
  Seed: CSQLTTLSFYGNSISISALQSLL (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQSLL

SEQ ID NO: 349783 - protein, 23 aa, Artificial Sequence
  Description of Artificial Sequence: Synthetic peptide
  Seed: CSQLTTLSFYGNSISISALQSLL (PRAME_HUMAN)
  Core: GNSISISAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYXNSXSXSAXQSLL

SEQ ID NO: 349784 - protein, 23 aa, Artificial Sequence
  Description of Artificial Sequence: Synthetic peptide
  Seed: CSQLTTLSFYGNSISISALQSLL (PRAME_HUMAN)
  Core: ISISALQSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYGNSXSIXAXQSXL

SEQ ID NO: 349785 - protein, 24 aa, Artificial Sequence
  Description of Artificial Sequence: Synthetic peptide
  Seed: CSQLTTLSFYGNSISISALQSLLQ (PRAME_HUMAN)
  Core: LTTLSFYGN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSQXTTXSXYGXSISISALQSLLQ

SEQ ID NO: 349786 - protein, 24 aa, Artificial Sequence
  Description of Artificial Sequence: Synthetic peptide
  Seed: CSQLTTLSFYGNSISISALQSLLQ (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQSLLQ

SEQ ID NO: 349787 - protein, 24 aa, Artificial Sequence
  Description of Artificial Sequence: Synthetic peptide
  Seed: CSQLTTLSFYGNSISISALQSLLQ (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQSLLQ

SEQ ID NO: 349788 - protein, 24 aa, Artificial Sequence
  Description of Artificial Sequence: Synthetic peptide
  Seed: CSQLTTLSFYGNSISISALQSLLQ (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQSLLQ

SEQ ID NO: 349789 - protein, 24 aa, Artificial Sequence
  Description of Artificial Sequence: Synthetic peptide
  Seed: CSQLTTLSFYGNSISISALQSLLQ (PRAME_HUMAN)
  Core: GNSISISAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYXNSXSXSAXQSLLQ

SEQ ID NO: 349790 - protein, 24 aa, Artificial Sequence
  Description of Artificial Sequence: Synthetic peptide
  Seed: CSQLTTLSFYGNSISISALQSLLQ (PRAME_HUMAN)
  Core: ISISALQSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYGNSXSIXAXQSXLQ

SEQ ID NO: 349791 - protein, 25 aa, Artificial Sequence
  Description of Artificial Sequence: Synthetic peptide
  Seed: CSQLTTLSFYGNSISISALQSLLQH (PRAME_HUMAN)
  Core: LSFYGNSIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTXSFXGXSIXISALQSLLQH

SEQ ID NO: 349792 - protein, 25 aa, Artificial Sequence
  Description of Artificial Sequence: Synthetic peptide
  Seed: CSQLTTLSFYGNSISISALQSLLQH (PRAME_HUMAN)
  Core: FYGNSISIS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSXYGXSXSIXALQSLLQH

SEQ ID NO: 349793 - protein, 25 aa, Artificial Sequence
  Description of Artificial Sequence: Synthetic peptide
  Seed: CSQLTTLSFYGNSISISALQSLLQH (PRAME_HUMAN)
  Core: YGNSISISA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFXGNXIXISXLQSLLQH

SEQ ID NO: 349794 - protein, 25 aa, Artificial Sequence
  Description of Artificial Sequence: Synthetic peptide
  Seed: CSQLTTLSFYGNSISISALQSLLQH (PRAME_HUMAN)
  Core: ISISALQSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYGNSXSIXAXQSXLQH

SEQ ID NO: 349795 - protein, 25 aa, Artificial Sequence
  Description of Artificial Sequence: Synthetic peptide
  Seed: CSQLTTLSFYGNSISISALQSLLQH (PRAME_HUMAN)
  Core: ISALQSLLQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
CSQLTTLSFYGNSISXSAXQXLLXH

SEQ ID NO: 349796 - protein, 15 aa, Artificial Sequence
  Description of Artificial Sequence: Synthetic peptide
  Seed: CTWKLPTLAKFSPYL (PRAME_HUMAN)
  Core: WKLPTLAKF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CTXKLXTXAKXSPYL

SEQ ID NO: 349797 - protein, 15 aa, Artificial Sequence
  Description of Artificial Sequence: Synthetic peptide
  Seed: CTWKLPTLAKFSPYL (PRAME_HUMAN)
  Core: KLPTLAKFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CTWXLPXLXKFXPYL

SEQ ID NO: 349798 - protein, 15 aa, Artificial Sequence
  Description of Artificial Sequence: Synthetic peptide
  Seed: CTWKLPTLAKFSPYL (PRAME_HUMAN)
  Core: LPTLAKFSP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CTWKXPTXAXFSXYL

SEQ ID NO: 349799 - protein, 15 aa, Artificial Sequence
  Description of Artificial Sequence: Synthetic peptide
  Seed: CTWKLPTLAKFSPYL (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXL

SEQ ID NO: 349800 - protein, 16 aa, Artificial Sequence
  Description of Artificial Sequence: Synthetic peptide
  Seed: CTWKLPTLAKFSPYLG (PRAME_HUMAN)
  Core: WKLPTLAKF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CTXKLXTXAKXSPYLG

SEQ ID NO: 349801 - protein, 16 aa, Artificial Sequence
  Description of Artificial Sequence: Synthetic peptide
  Seed: CTWKLPTLAKFSPYLG (PRAME_HUMAN)
  Core: KLPTLAKFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CTWXLPXLXKFXPYLG

SEQ ID NO: 349802 - protein, 16 aa, Artificial Sequence
  Description of Artificial Sequence: Synthetic peptide
  Seed: CTWKLPTLAKFSPYLG (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXLG

SEQ ID NO: 349803 - protein, 16 aa, Artificial Sequence
  Description of Artificial Sequence: Synthetic peptide
  Seed: CTWKLPTLAKFSPYLG (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLX

SEQ ID NO: 349804 - protein, 17 aa, Artificial Sequence
  Description of Artificial Sequence: Synthetic peptide
  Seed: CTWKLPTLAKFSPYLGQ (PRAME_HUMAN)
  Core: WKLPTLAKF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
CTXKLXTXAKXSPYLGQ

SEQ ID NO: 349805 - protein, 17 aa, Artificial Sequence
  Description of Artificial Sequence: Synthetic peptide
  Seed: CTWKLPTLAKFSPYLGQ (PRAME_HUMAN)
  Core: KLPTLAKFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CTWXLPXLXKFXPYLGQ

SEQ ID NO: 349806 - protein, 17 aa, Artificial Sequence
  Description of Artificial Sequence: Synthetic peptide
  Seed: CTWKLPTLAKFSPYLGQ (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXLGQ

SEQ ID NO: 349807 - protein, 17 aa, Artificial Sequence
  Description of Artificial Sequence: Synthetic peptide
  Seed: CTWKLPTLAKFSPYLGQ (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQ

SEQ ID NO: 349808 - protein, 18 aa, Artificial Sequence
  Description of Artificial Sequence: Synthetic peptide
  Seed: CTWKLPTLAKFSPYLGQM (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQM

SEQ ID NO: 349809 - protein, 19 aa, Artificial Sequence
  Description of Artificial Sequence: Synthetic peptide
  Seed: CTWKLPTLAKFSPYLGQMI (PRAME_HUMAN)
  Core: KLPTLAKFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CTWXLPXLXKFXPYLGQMI

SEQ ID NO: 349810 - protein, 19 aa, Artificial Sequence
  Description of Artificial Sequence: Synthetic peptide
  Seed: CTWKLPTLAKFSPYLGQMI (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXLGQMI

SEQ ID NO: 349811 - protein, 19 aa, Artificial Sequence
  Description of Artificial Sequence: Synthetic peptide
  Seed: CTWKLPTLAKFSPYLGQMI (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMI

SEQ ID NO: 349812 - protein, 19 aa, Artificial Sequence
  Description of Artificial Sequence: Synthetic peptide
  Seed: CTWKLPTLAKFSPYLGQMI (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMI

SEQ ID NO: 349813 - protein, 19 aa, Artificial Sequence
  Description of Artificial Sequence: Synthetic peptide
  Seed: CTWKLPTLAKFSPYLGQMI (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMX

SEQ ID NO: 349814 - protein, 20 aa, Artificial Sequence
  Description of Artificial Sequence: Synthetic peptide
  Seed: CTWKLPTLAKFSPYLGQMIN (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXLGQMIN

SEQ ID NO: 349815 - protein, 20 aa, Artificial Sequence
  Description of Artificial Sequence: Synthetic peptide
  Seed: CTWKLPTLAKFSPYLGQMIN (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMIN

SEQ ID NO: 349816 - protein, 20 aa, Artificial Sequence
  Description of Artificial Sequence: Synthetic peptide
  Seed: CTWKLPTLAKFSPYLGQMIN (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMIN

SEQ ID NO: 349817 - protein, 20 aa, Artificial Sequence
  Description of Artificial Sequence: Synthetic peptide
  Seed: CTWKLPTLAKFSPYLGQMIN (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXN

SEQ ID NO: 349818 - protein, 21 aa, Artificial Sequence
  Description of Artificial Sequence: Synthetic peptide
  Seed: CTWKLPTLAKFSPYLGQMINL (PRAME_HUMAN)
  Core: PTLAKFSPY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLXTLXKXSPXLGQMINL

SEQ ID NO: 349819 - protein, 21 aa, Artificial Sequence
  Description of Artificial Sequence: Synthetic peptide
  Seed: CTWKLPTLAKFSPYLGQMINL (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMINL

SEQ ID NO: 349820 - protein, 21 aa, Artificial Sequence
  Description of Artificial Sequence: Synthetic peptide
  Seed: CTWKLPTLAKFSPYLGQMINL (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMINL

SEQ ID NO: 349821 - protein, 21 aa, Artificial Sequence
  Description of Artificial Sequence: Synthetic peptide
  Seed: CTWKLPTLAKFSPYLGQMINL (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXNL

SEQ ID NO: 349822 - protein, 22 aa, Artificial Sequence
  Description of Artificial Sequence: Synthetic peptide
  Seed: CTWKLPTLAKFSPYLGQMINLR (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMINLR

SEQ ID NO: 349823 - protein, 22 aa, Artificial Sequence
  Description of Artificial Sequence: Synthetic peptide
  Seed: CTWKLPTLAKFSPYLGQMINLR (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMINLR

SEQ ID NO: 349824 - protein, 22 aa, Artificial Sequence
  Description of Artificial Sequence: Synthetic peptide
  Seed: CTWKLPTLAKFSPYLGQMINLR (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXNLR

SEQ ID NO: 349825 - protein, 22 aa, Artificial Sequence
  Description of Artificial Sequence: Synthetic peptide
  Seed: CTWKLPTLAKFSPYLGQMINLR (PRAME_HUMAN)
  Core: YLGQMINLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKFSPXLGXMXNLX

SEQ ID NO: 349826 - protein, 23 aa, Artificial Sequence
  Description of Artificial Sequence: Synthetic peptide
  Seed: CTWKLPTLAKFSPYLGQMINLRR (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMINLRR

SEQ ID NO: 349827 - protein, 23 aa, Artificial Sequence
  Description of Artificial Sequence: Synthetic peptide
  Seed: CTWKLPTLAKFSPYLGQMINLRR (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMINLRR

SEQ ID NO: 349828 - protein, 23 aa, Artificial Sequence
  Description of Artificial Sequence: Synthetic peptide
  Seed: CTWKLPTLAKFSPYLGQMINLRR (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXNLRR

SEQ ID NO: 349829 - protein, 23 aa, Artificial Sequence
  Description of Artificial Sequence: Synthetic peptide
  Seed: CTWKLPTLAKFSPYLGQMINLRR (PRAME_HUMAN)
  Core: YLGQMINLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKFSPXLGXMXNLXR

SEQ ID NO: 349830 - protein, 24 aa, Artificial Sequence
  Description of Artificial Sequence: Synthetic peptide
  Seed: CTWKLPTLAKFSPYLGQMINLRRL (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMINLRRL

SEQ ID NO: 349831 - protein, 24 aa, Artificial Sequence
  Description of Artificial Sequence: Synthetic peptide
  Seed: CTWKLPTLAKFSPYLGQMINLRRL (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMINLRRL

SEQ ID NO: 349832 - protein, 24 aa, Artificial Sequence
  Description of Artificial Sequence: Synthetic peptide
  Seed: CTWKLPTLAKFSPYLGQMINLRRL (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXNLRRL

SEQ ID NO: 349833 - protein, 24 aa, Artificial Sequence
  Description of Artificial Sequence: Synthetic peptide
  Seed: CTWKLPTLAKFSPYLGQMINLRRL (PRAME_HUMAN)
  Core: YLGQMINLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKFSPXLGXMXNLXRL

SEQ ID NO: 349834 - protein, 25 aa, Artificial Sequence
  Description of Artificial Sequence: Synthetic peptide
  Seed: CTWKLPTLAKFSPYLGQMINLRRLL (PRAME_HUMAN)
  Core: LAKFSPYLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTXAKXSXYLXQMINLRRLL

SEQ ID NO: 349835 - protein, 25 aa, Artificial Sequence
  Description of Artificial Sequence: Synthetic peptide
  Seed: CTWKLPTLAKFSPYLGQMINLRRLL (PRAME_HUMAN)
  Core: AKFSPYLGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLXKFXPXLGXMINLRRLL

SEQ ID NO: 349836 - protein, 25 aa, Artificial Sequence
  Description of Artificial Sequence: Synthetic peptide
  Seed: CTWKLPTLAKFSPYLGQMINLRRLL (PRAME_HUMAN)
  Core: FSPYLGQMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKXSPXLXQMXNLRRLL

SEQ ID NO: 349837 - protein, 25 aa, Artificial Sequence
  Description of Artificial Sequence: Synthetic peptide
  Seed: CTWKLPTLAKFSPYLGQMINLRRLL (PRAME_HUMAN)
  Core: YLGQMINLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKFSPXLGXMXNLXRLL

SEQ ID NO: 349838 - protein, 25 aa, Artificial Sequence
  Description of Artificial Sequence: Synthetic peptide
  Seed: CTWKLPTLAKFSPYLGQMINLRRLL (PRAME_HUMAN)
  Core: LGQMINLRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
CTWKLPTLAKFSPYXGQXIXLRXLL

SEQ ID NO: 349839 - protein, 13 aa, Artificial Sequence
  Description of Artificial Sequence: Synthetic peptide
  Seed: DDQLLALLPSLSH (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXH

SEQ ID NO: 349840 - protein, 13 aa, Artificial Sequence
  Description of Artificial Sequence: Synthetic peptide
  Seed: DDQLLALLPSLSH (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSX

SEQ ID NO: 349841 - protein, 14 aa, Artificial Sequence
  Description of Artificial Sequence: Synthetic peptide
  Seed: DDQLLALLPSLSHC (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHC

SEQ ID NO: 349842 - protein, 14 aa, Artificial Sequence
  Description of Artificial Sequence: Synthetic peptide
  Seed: DDQLLALLPSLSHC (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXC

SEQ ID NO: 349843 - protein, 15 aa, Artificial Sequence
  Description of Artificial Sequence: Synthetic peptide
  Seed: DDQLLALLPSLSHCS (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCS

SEQ ID NO: 349844 - protein, 15 aa, Artificial Sequence
  Description of Artificial Sequence: Synthetic peptide
  Seed: DDQLLALLPSLSHCS (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCS

SEQ ID NO: 349845 - protein, 16 aa, Artificial Sequence
  Description of Artificial Sequence: Synthetic peptide
  Seed: DDQLLALLPSLSHCSQ (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQ

SEQ ID NO: 349846 - protein, 16 aa, Artificial Sequence
  Description of Artificial Sequence: Synthetic peptide
  Seed: DDQLLALLPSLSHCSQ (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQ

SEQ ID NO: 349847 - protein, 17 aa, Artificial Sequence
  Description of Artificial Sequence: Synthetic peptide
  Seed: DDQLLALLPSLSHCSQL (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQL

SEQ ID NO: 349848 - protein, 17 aa, Artificial Sequence
  Description of Artificial Sequence: Synthetic peptide
  Seed: DDQLLALLPSLSHCSQL (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQL

SEQ ID NO: 349849 - protein, 17 aa, Artificial Sequence
  Description of Artificial Sequence: Synthetic peptide
  Seed: DDQLLALLPSLSHCSQL (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQL

SEQ ID NO: 349850 - protein, 18 aa, Artificial Sequence
  Description of Artificial Sequence: Synthetic peptide
  Seed: DDQLLALLPSLSHCSQLT (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLT

SEQ ID NO: 349851 - protein, 18 aa, Artificial Sequence
  Description of Artificial Sequence: Synthetic peptide
  Seed: DDQLLALLPSLSHCSQLT (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLT

SEQ ID NO: 349852 - protein, 18 aa, Artificial Sequence
  Description of Artificial Sequence: Synthetic peptide
  Seed: DDQLLALLPSLSHCSQLT (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLT

SEQ ID NO: 349853 - protein, 19 aa, Artificial Sequence
  Description of Artificial Sequence: Synthetic peptide
  Seed: DDQLLALLPSLSHCSQLTT (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTT

SEQ ID NO: 349854 - protein, 19 aa, Artificial Sequence
  Description of Artificial Sequence: Synthetic peptide
  Seed: DDQLLALLPSLSHCSQLTT (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTT

SEQ ID NO: 349855 - protein, 19 aa, Artificial Sequence
  Description of Artificial Sequence: Synthetic peptide
  Seed: DDQLLALLPSLSHCSQLTT (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTT

SEQ ID NO: 349856 - protein, 20 aa, Artificial Sequence
  Description of Artificial Sequence: Synthetic peptide
  Seed: DDQLLALLPSLSHCSQLTTL (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTL

SEQ ID NO: 349857 - protein, 20 aa, Artificial Sequence
  Description of Artificial Sequence: Synthetic peptide
  Seed: DDQLLALLPSLSHCSQLTTL (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTL

SEQ ID NO: 349858 - protein, 20 aa, Artificial Sequence
  Description of Artificial Sequence: Synthetic peptide
  Seed: DDQLLALLPSLSHCSQLTTL (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTL

SEQ ID NO: 349859 - protein, 21 aa, Artificial Sequence
  Description of Artificial Sequence: Synthetic peptide
  Seed: DDQLLALLPSLSHCSQLTTLS (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTLS

SEQ ID NO: 349860 - protein, 21 aa, Artificial Sequence
  Description of Artificial Sequence: Synthetic peptide
  Seed: DDQLLALLPSLSHCSQLTTLS (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTLS

SEQ ID NO: 349861 - protein, 21 aa, Artificial Sequence
  Description of Artificial Sequence: Synthetic peptide
  Seed: DDQLLALLPSLSHCSQLTTLS (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTLS

SEQ ID NO: 349862 - protein, 22 aa, Artificial Sequence
  Description of Artificial Sequence: Synthetic peptide
  Seed: DDQLLALLPSLSHCSQLTTLSF (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTLSF

SEQ ID NO: 349863 - protein, 22 aa, Artificial Sequence
  Description of Artificial Sequence: Synthetic peptide
  Seed: DDQLLALLPSLSHCSQLTTLSF (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTLSF

SEQ ID NO: 349864 - protein, 22 aa, Artificial Sequence
  Description of Artificial Sequence: Synthetic peptide
  Seed: DDQLLALLPSLSHCSQLTTLSF (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTLSF

SEQ ID NO: 349865 - protein, 23 aa, Artificial Sequence
  Description of Artificial Sequence: Synthetic peptide
  Seed: DDQLLALLPSLSHCSQLTTLSFY (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTLSFY

SEQ ID NO: 349866 - protein, 23 aa, Artificial Sequence
  Description of Artificial Sequence: Synthetic peptide
  Seed: DDQLLALLPSLSHCSQLTTLSFY (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTLSFY

SEQ ID NO: 349867 - protein, 23 aa, Artificial Sequence
  Description of Artificial Sequence: Synthetic peptide
  Seed: DDQLLALLPSLSHCSQLTTLSFY (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTLSFY

SEQ ID NO: 349868 - protein, 23 aa, Artificial Sequence
  Description of Artificial Sequence: Synthetic peptide
  Seed: DDQLLALLPSLSHCSQLTTLSFY (PRAME_HUMAN)
  Core: SHCSQLTTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLALLPSLXHCXQXTTXSFY

SEQ ID NO: 349869 - protein, 24 aa, Artificial Sequence
  Description of Artificial Sequence: Synthetic peptide
  Seed: DDQLLALLPSLSHCSQLTTLSFYG (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTLSFYG

SEQ ID NO: 349870 - protein, 24 aa, Artificial Sequence
  Description of Artificial Sequence: Synthetic peptide
  Seed: DDQLLALLPSLSHCSQLTTLSFYG (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTLSFYG

SEQ ID NO: 349871 - protein, 24 aa, Artificial Sequence
  Description of Artificial Sequence: Synthetic peptide
  Seed: DDQLLALLPSLSHCSQLTTLSFYG (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTLSFYG

SEQ ID NO: 349872 - protein, 24 aa, Artificial Sequence
  Description of Artificial Sequence: Synthetic peptide
  Seed: DDQLLALLPSLSHCSQLTTLSFYG (PRAME_HUMAN)
  Core: SHCSQLTTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLALLPSLXHCXQXTTXSFYG

SEQ ID NO: 349873 - protein, 25 aa, Artificial Sequence
  Description of Artificial Sequence: Synthetic peptide
  Seed: DDQLLALLPSLSHCSQLTTLSFYGN (PRAME_HUMAN)
  Core: LLALLPSLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDQXLAXLXSLXHCSQLTTLSFYGN

SEQ ID NO: 349874 - protein, 25 aa, Artificial Sequence
  Description of Artificial Sequence: Synthetic peptide
  Seed: DDQLLALLPSLSHCSQLTTLSFYGN (PRAME_HUMAN)
  Core: LALLPSLSH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDQLXALXPXLSXCSQLTTLSFYGN

SEQ ID NO: 349875 - protein, 25 aa, Artificial Sequence
  Description of Artificial Sequence: Synthetic peptide
  Seed: DDQLLALLPSLSHCSQLTTLSFYGN (PRAME_HUMAN)
  Core: LLPSLSHCS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLAXLPXLXHCXQLTTLSFYGN

SEQ ID NO: 349876 - protein, 25 aa, Artificial Sequence
  Description of Artificial Sequence: Synthetic peptide
  Seed: DDQLLALLPSLSHCSQLTTLSFYGN (PRAME_HUMAN)
  Core: SHCSQLTTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLALLPSLXHCXQXTTXSFYGN

SEQ ID NO: 349877 - protein, 25 aa, Artificial Sequence
  Description of Artificial Sequence: Synthetic peptide
  Seed: DDQLLALLPSLSHCSQLTTLSFYGN (PRAME_HUMAN)
  Core: QLTTLSFYG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLALLPSLSHCSXLTXLXFYXN

SEQ ID NO: 349878 - protein, 25 aa, Artificial Sequence
  Description of Artificial Sequence: Synthetic peptide
  Seed: DDQLLALLPSLSHCSQLTTLSFYGN (PRAME_HUMAN)
  Core: LTTLSFYGN
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
DDQLLALLPSLSHCSQXTTXSXYGX

SEQ ID NO: 349879 - protein, 13 aa, Artificial Sequence
  Description of Artificial Sequence: Synthetic peptide
  Seed: DEALAIAALELLP (PRAME_HUMAN)
  Core: EALAIAALE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXALXIXALXLLP

SEQ ID NO: 349880 - protein, 13 aa, Artificial Sequence
  Description of Artificial Sequence: Synthetic peptide
  Seed: DEALAIAALELLP (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXP

SEQ ID NO: 349881 - protein, 14 aa, Artificial Sequence
  Description of Artificial Sequence: Synthetic peptide
  Seed: DEALAIAALELLPR (PRAME_HUMAN)
  Core: EALAIAALE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXALXIXALXLLPR

SEQ ID NO: 349882 - protein, 14 aa, Artificial Sequence
  Description of Artificial Sequence: Synthetic peptide
  Seed: DEALAIAALELLPR (PRAME_HUMAN)
  Core: ALAIAALEL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXLAXAXLEXLPR

SEQ ID NO: 349883 - protein, 14 aa, Artificial Sequence
  Description of Artificial Sequence: Synthetic peptide
  Seed: DEALAIAALELLPR (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPR

SEQ ID NO: 349884 - protein, 14 aa, Artificial Sequence
  Description of Artificial Sequence: Synthetic peptide
  Seed: DEALAIAALELLPR (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPX

SEQ ID NO: 349885 - protein, 15 aa, Artificial Sequence
  Description of Artificial Sequence: Synthetic peptide
  Seed: DEALAIAALELLPRE (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRE

SEQ ID NO: 349886 - protein, 15 aa, Artificial Sequence
  Description of Artificial Sequence: Synthetic peptide
  Seed: DEALAIAALELLPRE (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXE

SEQ ID NO: 349887 - protein, 16 aa, Artificial Sequence
  Description of Artificial Sequence: Synthetic peptide
  Seed: DEALAIAALELLPREL (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPREL

SEQ ID NO: 349888 - protein, 16 aa, Artificial Sequence
  Description of Artificial Sequence: Synthetic peptide
  Seed: DEALAIAALELLPREL (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXEL

SEQ ID NO: 349889 - protein, 17 aa, Artificial Sequence
  Description of Artificial Sequence: Synthetic peptide
  Seed: DEALAIAALELLPRELF (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELF

SEQ ID NO: 349890 - protein, 17 aa, Artificial Sequence
  Description of Artificial Sequence: Synthetic peptide
  Seed: DEALAIAALELLPRELF (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELF

SEQ ID NO: 349891 - protein, 18 aa, Artificial Sequence
  Description of Artificial Sequence: Synthetic peptide
  Seed: DEALAIAALELLPRELFP (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFP

SEQ ID NO: 349892 - protein, 18 aa, Artificial Sequence
  Description of Artificial Sequence: Synthetic peptide
  Seed: DEALAIAALELLPRELFP (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFP

SEQ ID NO: 349893 - protein, 19 aa, Artificial Sequence
  Description of Artificial Sequence: Synthetic peptide
  Seed: DEALAIAALELLPRELFPP (PRAME_HUMAN)
  Core: EALAIAALE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXALXIXALXLLPRELFPP

SEQ ID NO: 349894 - protein, 19 aa, Artificial Sequence
  Description of Artificial Sequence: Synthetic peptide
  Seed: DEALAIAALELLPRELFPP (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPP

SEQ ID NO: 349895 - protein, 19 aa, Artificial Sequence
  Description of Artificial Sequence: Synthetic peptide
  Seed: DEALAIAALELLPRELFPP (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPP

SEQ ID NO: 349896 - protein, 19 aa, Artificial Sequence
  Description of Artificial Sequence: Synthetic peptide
  Seed: DEALAIAALELLPRELFPP (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPP

SEQ ID NO: 349897 - protein, 20 aa, Artificial Sequence
  Description of Artificial Sequence: Synthetic peptide
  Seed: DEALAIAALELLPRELFPPL (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPL

SEQ ID NO: 349898 - protein, 20 aa, Artificial Sequence
  Description of Artificial Sequence: Synthetic peptide
  Seed: DEALAIAALELLPRELFPPL (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPL

SEQ ID NO: 349899 - protein, 20 aa, Artificial Sequence
  Description of Artificial Sequence: Synthetic peptide
  Seed: DEALAIAALELLPRELFPPL (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPL

SEQ ID NO: 349900 - protein, 21 aa, Artificial Sequence
  Description of Artificial Sequence: Synthetic peptide
  Seed: DEALAIAALELLPRELFPPLF (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPLF

SEQ ID NO: 349901 - protein, 21 aa, Artificial Sequence
  Description of Artificial Sequence: Synthetic peptide
  Seed: DEALAIAALELLPRELFPPLF (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPLF

SEQ ID NO: 349902 - protein, 21 aa, Artificial Sequence
  Description of Artificial Sequence: Synthetic peptide
  Seed: DEALAIAALELLPRELFPPLF (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPLF

SEQ ID NO: 349903 - protein, 21 aa, Artificial Sequence
  Description of Artificial Sequence: Synthetic peptide
  Seed: DEALAIAALELLPRELFPPLF (PRAME_HUMAN)
  Core: LLPRELFPP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALEXLPXEXFPXLF

SEQ ID NO: 349904 - protein, 22 aa, Artificial Sequence
  Description of Artificial Sequence: Synthetic peptide
  Seed: DEALAIAALELLPRELFPPLFM (PRAME_HUMAN)
  Core: ALAIAALEL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXLAXAXLEXLPRELFPPLFM

SEQ ID NO: 349905 - protein, 22 aa, Artificial Sequence
  Description of Artificial Sequence: Synthetic peptide
  Seed: DEALAIAALELLPRELFPPLFM (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPLFM

SEQ ID NO: 349906 - protein, 22 aa, Artificial Sequence
  Description of Artificial Sequence: Synthetic peptide
  Seed: DEALAIAALELLPRELFPPLFM (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPLFM

SEQ ID NO: 349907 - protein, 22 aa, Artificial Sequence
  Description of Artificial Sequence: Synthetic peptide
  Seed: DEALAIAALELLPRELFPPLFM (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPLFM

SEQ ID NO: 349908 - protein, 22 aa, Artificial Sequence
  Description of Artificial Sequence: Synthetic peptide
  Seed: DEALAIAALELLPRELFPPLFM (PRAME_HUMAN)
  Core: LLPRELFPP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALEXLPXEXFPXLFM

SEQ ID NO: 349909 - protein, 22 aa, Artificial Sequence
  Description of Artificial Sequence: Synthetic peptide
  Seed: DEALAIAALELLPRELFPPLFM (PRAME_HUMAN)
  Core: PRELFPPLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLXREXFXPLXM

SEQ ID NO: 349910 - protein, 23 aa, Artificial Sequence
  Description of Artificial Sequence: Synthetic peptide
  Seed: DEALAIAALELLPRELFPPLFMA (PRAME_HUMAN)
  Core: ALAIAALEL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXLAXAXLEXLPRELFPPLFMA

SEQ ID NO: 349911 - protein, 23 aa, Artificial Sequence
  Description of Artificial Sequence: Synthetic peptide
  Seed: DEALAIAALELLPRELFPPLFMA (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPLFMA

SEQ ID NO: 349912 - protein, 23 aa, Artificial Sequence
  Description of Artificial Sequence: Synthetic peptide
  Seed: DEALAIAALELLPRELFPPLFMA (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPLFMA

SEQ ID NO: 349913 - protein, 23 aa, Artificial Sequence
  Description of Artificial Sequence: Synthetic peptide
  Seed: DEALAIAALELLPRELFPPLFMA (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPLFMA

SEQ ID NO: 349914 - protein, 23 aa, Artificial Sequence
  Description of Artificial Sequence: Synthetic peptide
  Seed: DEALAIAALELLPRELFPPLFMA (PRAME_HUMAN)
  Core: LLPRELFPP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALEXLPXEXFPXLFMA

SEQ ID NO: 349915 - protein, 23 aa, Artificial Sequence
  Description of Artificial Sequence: Synthetic peptide
  Seed: DEALAIAALELLPRELFPPLFMA (PRAME_HUMAN)
  Core: PRELFPPLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLXREXFXPLXMA

SEQ ID NO: 349916 - protein, 23 aa, Artificial Sequence
  Description of Artificial Sequence: Synthetic peptide
  Seed: DEALAIAALELLPRELFPPLFMA (PRAME_HUMAN)
  Core: RELFPPLFM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLPXELXPXLFXA

SEQ ID NO: 349917 - protein, 24 aa, Artificial Sequence
  Description of Artificial Sequence: Synthetic peptide
  Seed: DEALAIAALELLPRELFPPLFMAA (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPLFMAA

SEQ ID NO: 349918 - protein, 24 aa, Artificial Sequence
  Description of Artificial Sequence: Synthetic peptide
  Seed: DEALAIAALELLPRELFPPLFMAA (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPLFMAA

SEQ ID NO: 349919 - protein, 24 aa, Artificial Sequence
  Description of Artificial Sequence: Synthetic peptide
  Seed: DEALAIAALELLPRELFPPLFMAA (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPLFMAA

SEQ ID NO: 349920 - protein, 24 aa, Artificial Sequence
  Description of Artificial Sequence: Synthetic peptide
  Seed: DEALAIAALELLPRELFPPLFMAA (PRAME_HUMAN)
  Core: LLPRELFPP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALEXLPXEXFPXLFMAA

SEQ ID NO: 349921 - protein, 24 aa, Artificial Sequence
  Description of Artificial Sequence: Synthetic peptide
  Seed: DEALAIAALELLPRELFPPLFMAA (PRAME_HUMAN)
  Core: PRELFPPLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLXREXFXPLXMAA

SEQ ID NO: 349922 - protein, 24 aa, Artificial Sequence
  Description of Artificial Sequence: Synthetic peptide
  Seed: DEALAIAALELLPRELFPPLFMAA (PRAME_HUMAN)
  Core: RELFPPLFM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLPXELXPXLFXAA

SEQ ID NO: 349923 - protein, 24 aa, Artificial Sequence
  Description of Artificial Sequence: Synthetic peptide
  Seed: DEALAIAALELLPRELFPPLFMAA (PRAME_HUMAN)
  Core: LFPPLFMAA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLPREXFPXLXMAX

SEQ ID NO: 349924 - protein, 25 aa, Artificial Sequence
  Description of Artificial Sequence: Synthetic peptide
  Seed: DEALAIAALELLPRELFPPLFMAAF (PRAME_HUMAN)
  Core: ALAIAALEL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXLAXAXLEXLPRELFPPLFMAAF

SEQ ID NO: 349925 - protein, 25 aa, Artificial Sequence
  Description of Artificial Sequence: Synthetic peptide
  Seed: DEALAIAALELLPRELFPPLFMAAF (PRAME_HUMAN)
  Core: LAIAALELL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEAXAIXAXELXPRELFPPLFMAAF

SEQ ID NO: 349926 - protein, 25 aa, Artificial Sequence
  Description of Artificial Sequence: Synthetic peptide
  Seed: DEALAIAALELLPRELFPPLFMAAF (PRAME_HUMAN)
  Core: IAALELLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DEALAXAAXEXLPXELFPPLFMAAF

SEQ ID NO: 349927 - protein, 25 aa, Artificial Sequence
  Description of Artificial Sequence: Synthetic peptide
  Seed: DEALAIAALELLPRELFPPLFMAAF (PRAME_HUMAN)
  Core: LELLPRELF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAAXELXPXELXPPLFMAAF

SEQ ID NO: 349928 - protein, 25 aa, Artificial Sequence
  Description of Artificial Sequence: Synthetic peptide
  Seed: DEALAIAALELLPRELFPPLFMAAF (PRAME_HUMAN)
  Core: LLPRELFPP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALEXLPXEXFPXLFMAAF

SEQ ID NO: 349929 - protein, 25 aa, Artificial Sequence
  Description of Artificial Sequence: Synthetic peptide
  Seed: DEALAIAALELLPRELFPPLFMAAF (PRAME_HUMAN)
  Core: PRELFPPLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLXREXFXPLXMAAF

SEQ ID NO: 349930 - protein, 25 aa, Artificial Sequence
  Description of Artificial Sequence: Synthetic peptide
  Seed: DEALAIAALELLPRELFPPLFMAAF (PRAME_HUMAN)
  Core: RELFPPLFM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLPXELXPXLFXAAF

SEQ ID NO: 349931 - protein, 25 aa, Artificial Sequence
  Description of Artificial Sequence: Synthetic peptide
  Seed: DEALAIAALELLPRELFPPLFMAAF (PRAME_HUMAN)
  Core: LFPPLFMAA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DEALAIAALELLPREXFPXLXMAXF

SEQ ID NO: 349932 - protein, 14 aa, Artificial Sequence
  Description of Artificial Sequence: Synthetic peptide
  Seed: DECGITDDQLLALL (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXL

SEQ ID NO: 349933 - protein, 15 aa, Artificial Sequence
  Description of Artificial Sequence: Synthetic peptide
  Seed: DECGITDDQLLALLP (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLP

SEQ ID NO: 349934 - protein, 16 aa, Artificial Sequence
  Description of Artificial Sequence: Synthetic peptide
  Seed: DECGITDDQLLALLPS (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPS

SEQ ID NO: 349935 - protein, 17 aa, Artificial Sequence
  Description of Artificial Sequence: Synthetic peptide
  Seed: DECGITDDQLLALLPSL (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSL

SEQ ID NO: 349936 - protein, 17 aa, Artificial Sequence
  Description of Artificial Sequence: Synthetic peptide
  Seed: DECGITDDQLLALLPSL (PRAME_HUMAN)
  Core: DQLLALLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDXQLXAXLPXL

SEQ ID NO: 349937 - protein, 18 aa, Artificial Sequence
  Description of Artificial Sequence: Synthetic peptide
  Seed: DECGITDDQLLALLPSLS (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLS

SEQ ID NO: 349938 - protein, 18 aa, Artificial Sequence
  Description of Artificial Sequence: Synthetic peptide
  Seed: DECGITDDQLLALLPSLS (PRAME_HUMAN)
  Core: DQLLALLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDXQLXAXLPXLS

SEQ ID NO: 349939 - protein, 18 aa, Artificial Sequence
  Description of Artificial Sequence: Synthetic peptide
  Seed: DECGITDDQLLALLPSLS (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLX

SEQ ID NO: 349940 - protein, 19 aa, Artificial Sequence
  Description of Artificial Sequence: Synthetic peptide
  Seed: DECGITDDQLLALLPSLSH (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSH

SEQ ID NO: 349941 - protein, 19 aa, Artificial Sequence
  Description of Artificial Sequence: Synthetic peptide
  Seed: DECGITDDQLLALLPSLSH (PRAME_HUMAN)
  Core: DQLLALLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDXQLXAXLPXLSH

SEQ ID NO: 349942 - protein, 19 aa, Artificial Sequence
  Description of Artificial Sequence: Synthetic peptide
  Seed: DECGITDDQLLALLPSLSH (PRAME_HUMAN)
  Core: QLLALLPSL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDXLLXLXPSXSH

SEQ ID NO: 349943 - protein, 19 aa, Artificial Sequence
  Description of Artificial Sequence: Synthetic peptide
  Seed: DECGITDDQLLALLPSLSH (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXH

SEQ ID NO: 349944 - protein, 20 aa, Artificial Sequence
  Description of Artificial Sequence: Synthetic peptide
  Seed: DECGITDDQLLALLPSLSHC (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHC

SEQ ID NO: 349945 - protein, 20 aa, Artificial Sequence
  Description of Artificial Sequence: Synthetic peptide
  Seed: DECGITDDQLLALLPSLSHC (PRAME_HUMAN)
  Core: DQLLALLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDXQLXAXLPXLSHC

SEQ ID NO: 349946 - protein, 20 aa, Artificial Sequence
  Description of Artificial Sequence: Synthetic peptide
  Seed: DECGITDDQLLALLPSLSHC (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHC

SEQ ID NO: 349947 - protein, 20 aa, Artificial Sequence
  Description of Artificial Sequence: Synthetic peptide
  Seed: DECGITDDQLLALLPSLSHC (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXC

SEQ ID NO: 349948 - protein, 21 aa, Artificial Sequence
  Description of Artificial Sequence: Synthetic peptide
  Seed: DECGITDDQLLALLPSLSHCS (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHCS

SEQ ID NO: 349949 - protein, 21 aa, Artificial Sequence
  Description of Artificial Sequence: Synthetic peptide
  Seed: DECGITDDQLLALLPSLSHCS (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHCS

SEQ ID NO: 349950 - protein, 21 aa, Artificial Sequence
  Description of Artificial Sequence: Synthetic peptide
  Seed: DECGITDDQLLALLPSLSHCS (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXCS

SEQ ID NO: 349951 - protein, 22 aa, Artificial Sequence
  Description of Artificial Sequence: Synthetic peptide
  Seed: DECGITDDQLLALLPSLSHCSQ (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHCSQ

SEQ ID NO: 349952 - protein, 22 aa, Artificial Sequence
  Description of Artificial Sequence: Synthetic peptide
  Seed: DECGITDDQLLALLPSLSHCSQ (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHCSQ

SEQ ID NO: 349953 - protein, 22 aa, Artificial Sequence
  Description of Artificial Sequence: Synthetic peptide
  Seed: DECGITDDQLLALLPSLSHCSQ (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXCSQ

SEQ ID NO: 349954 - protein, 23 aa, Artificial Sequence
  Description of Artificial Sequence: Synthetic peptide
  Seed: DECGITDDQLLALLPSLSHCSQL (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHCSQL

SEQ ID NO: 349955 - protein, 23 aa, Artificial Sequence
  Description of Artificial Sequence: Synthetic peptide
  Seed: DECGITDDQLLALLPSLSHCSQL (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHCSQL

SEQ ID NO: 349956 - protein, 23 aa, Artificial Sequence
  Description of Artificial Sequence: Synthetic peptide
  Seed: DECGITDDQLLALLPSLSHCSQL (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXCSQL

SEQ ID NO: 349957 - protein, 23 aa, Artificial Sequence
  Description of Artificial Sequence: Synthetic peptide
  Seed: DECGITDDQLLALLPSLSHCSQL (PRAME_HUMAN)
  Core: LLPSLSHCS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLLAXLPXLXHCXQL

SEQ ID NO: 349958 - protein, 24 aa, Artificial Sequence
  Description of Artificial Sequence: Synthetic peptide
  Seed: DECGITDDQLLALLPSLSHCSQLT (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHCSQLT

SEQ ID NO: 349959 - protein, 24 aa, Artificial Sequence
  Description of Artificial Sequence: Synthetic peptide
  Seed: DECGITDDQLLALLPSLSHCSQLT (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHCSQLT

SEQ ID NO: 349960 - protein, 24 aa, Artificial Sequence
  Description of Artificial Sequence: Synthetic peptide
  Seed: DECGITDDQLLALLPSLSHCSQLT (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXCSQLT

SEQ ID NO: 349961 - protein, 24 aa, Artificial Sequence
  Description of Artificial Sequence: Synthetic peptide
  Seed: DECGITDDQLLALLPSLSHCSQLT (PRAME_HUMAN)
  Core: LLPSLSHCS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLLAXLPXLXHCXQLT

SEQ ID NO: 349962 - protein, 25 aa, Artificial Sequence
  Description of Artificial Sequence: Synthetic peptide
  Seed: DECGITDDQLLALLPSLSHCSQLTT (PRAME_HUMAN)
  Core: ITDDQLLAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DECGXTDXQXLAXLPSLSHCSQLTT

SEQ ID NO: 349963 - protein, 25 aa, Artificial Sequence
  Description of Artificial Sequence: Synthetic peptide
  Seed: DECGITDDQLLALLPSLSHCSQLTT (PRAME_HUMAN)
  Core: LLALLPSLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQXLAXLXSLXHCSQLTT

SEQ ID NO: 349964 - protein, 25 aa, Artificial Sequence
  Description of Artificial Sequence: Synthetic peptide
  Seed: DECGITDDQLLALLPSLSHCSQLTT (PRAME_HUMAN)
  Core: LALLPSLSH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLXALXPXLSXCSQLTT

SEQ ID NO: 349965 - protein, 25 aa, Artificial Sequence
  Description of Artificial Sequence: Synthetic peptide
  Seed: DECGITDDQLLALLPSLSHCSQLTT (PRAME_HUMAN)
  Core: LLPSLSHCS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DECGITDDQLLAXLPXLXHCXQLTT

SEQ ID NO: 349966 - protein, 13 aa, Artificial Sequence
  Description of Artificial Sequence: Synthetic peptide
  Seed: DELFSYLIEKVKR (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKR

SEQ ID NO: 349967 - protein, 13 aa, Artificial Sequence
  Description of Artificial Sequence: Synthetic peptide
  Seed: DELFSYLIEKVKR (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXR

SEQ ID NO: 349968 - protein, 14 aa, Artificial Sequence
  Description of Artificial Sequence: Synthetic peptide
  Seed: DELFSYLIEKVKRK (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRK

SEQ ID NO: 349969 - protein, 14 aa, Artificial Sequence
  Description of Artificial Sequence: Synthetic peptide
  Seed: DELFSYLIEKVKRK (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRK

SEQ ID NO: 349970 - protein, 15 aa, Artificial Sequence
  Description of Artificial Sequence: Synthetic peptide
  Seed: DELFSYLIEKVKRKK (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKK

SEQ ID NO: 349971 - protein, 15 aa, Artificial Sequence
  Description of Artificial Sequence: Synthetic peptide
  Seed: DELFSYLIEKVKRKK (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKK

SEQ ID NO: 349972 - protein, 15 aa, Artificial Sequence
  Description of Artificial Sequence: Synthetic peptide
  Seed: DELFSYLIEKVKRKK (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXK

SEQ ID NO: 349973 - protein, 16 aa, Artificial Sequence
  Description of Artificial Sequence: Synthetic peptide
  Seed: DELFSYLIEKVKRKKN (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKN

SEQ ID NO: 349974 - protein, 16 aa, Artificial Sequence
  Description of Artificial Sequence: Synthetic peptide
  Seed: DELFSYLIEKVKRKKN (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKN

SEQ ID NO: 349975 - protein, 16 aa, Artificial Sequence
  Description of Artificial Sequence: Synthetic peptide
  Seed: DELFSYLIEKVKRKKN (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKN

SEQ ID NO: 349976 - protein, 16 aa, Artificial Sequence
  Description of Artificial Sequence: Synthetic peptide
  Seed: DELFSYLIEKVKRKKN (PRAME_HUMAN)
  Core: LIEKVKRKK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYXIEXVXRKXN

SEQ ID NO: 349977 - protein, 16 aa, Artificial Sequence
  Description of Artificial Sequence: Synthetic peptide
  Seed: DELFSYLIEKVKRKKN (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKX

SEQ ID NO: 349978 - protein, 17 aa, Artificial Sequence
  Description of Artificial Sequence: Synthetic peptide
  Seed: DELFSYLIEKVKRKKNV (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNV

SEQ ID NO: 349979 - protein, 17 aa, Artificial Sequence
  Description of Artificial Sequence: Synthetic peptide
  Seed: DELFSYLIEKVKRKKNV (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNV

SEQ ID NO: 349980 - protein, 17 aa, Artificial Sequence
  Description of Artificial Sequence: Synthetic peptide
  Seed: DELFSYLIEKVKRKKNV (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNV

SEQ ID NO: 349981 - protein, 17 aa, Artificial Sequence
  Description of Artificial Sequence: Synthetic peptide
  Seed: DELFSYLIEKVKRKKNV (PRAME_HUMAN)
  Core: LIEKVKRKK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYXIEXVXRKXNV

SEQ ID NO: 349982 - protein, 17 aa, Artificial Sequence
  Description of Artificial Sequence: Synthetic peptide
  Seed: DELFSYLIEKVKRKKNV (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXV

SEQ ID NO: 349983 - protein, 18 aa, Artificial Sequence
  Description of Artificial Sequence: Synthetic peptide
  Seed: DELFSYLIEKVKRKKNVL (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVL

SEQ ID NO: 349984 - protein, 18 aa, Artificial Sequence
  Description of Artificial Sequence: Synthetic peptide
  Seed: DELFSYLIEKVKRKKNVL (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVL

SEQ ID NO: 349985 - protein, 18 aa, Artificial Sequence
  Description of Artificial Sequence: Synthetic peptide
  Seed: DELFSYLIEKVKRKKNVL (PRAME_HUMAN)
  Core: LIEKVKRKK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYXIEXVXRKXNVL

SEQ ID NO: 349986 - protein, 18 aa, Artificial Sequence
  Description of Artificial Sequence: Synthetic peptide
  Seed: DELFSYLIEKVKRKKNVL (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVL

SEQ ID NO: 349987 - protein, 19 aa, Artificial Sequence
  Description of Artificial Sequence: Synthetic peptide
  Seed: DELFSYLIEKVKRKKNVLR (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLR

SEQ ID NO: 349988 - protein, 19 aa, Artificial Sequence
  Description of Artificial Sequence: Synthetic peptide
  Seed: DELFSYLIEKVKRKKNVLR (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLR

SEQ ID NO: 349989 - protein, 19 aa, Artificial Sequence
  Description of Artificial Sequence: Synthetic peptide
  Seed: DELFSYLIEKVKRKKNVLR (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLR

SEQ ID NO: 349990 - protein, 19 aa, Artificial Sequence
  Description of Artificial Sequence: Synthetic peptide
  Seed: DELFSYLIEKVKRKKNVLR (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLR

SEQ ID NO: 349991 - protein, 20 aa, Artificial Sequence
  Description of Artificial Sequence: Synthetic peptide
  Seed: DELFSYLIEKVKRKKNVLRL (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRL

SEQ ID NO: 349992 - protein, 20 aa, Artificial Sequence
  Description of Artificial Sequence: Synthetic peptide
  Seed: DELFSYLIEKVKRKKNVLRL (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRL

SEQ ID NO: 349993 - protein, 20 aa, Artificial Sequence
  Description of Artificial Sequence: Synthetic peptide
  Seed: DELFSYLIEKVKRKKNVLRL (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRL

SEQ ID NO: 349994 - protein, 20 aa, Artificial Sequence
  Description of Artificial Sequence: Synthetic peptide
  Seed: DELFSYLIEKVKRKKNVLRL (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRL

SEQ ID NO: 349995 - protein, 20 aa, Artificial Sequence
  Description of Artificial Sequence: Synthetic peptide
  Seed: DELFSYLIEKVKRKKNVLRL (PRAME_HUMAN)
  Core: VKRKKNVLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKXKRXKXVLXL

SEQ ID NO: 349996 - protein, 20 aa, Artificial Sequence
  Description of Artificial Sequence: Synthetic peptide
  Seed: DELFSYLIEKVKRKKNVLRL (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRX

SEQ ID NO: 349997 - protein, 21 aa, Artificial Sequence
  Description of Artificial Sequence: Synthetic peptide
  Seed: DELFSYLIEKVKRKKNVLRLC (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRLC

SEQ ID NO: 349998 - protein, 21 aa, Artificial Sequence
  Description of Artificial Sequence: Synthetic peptide
  Seed: DELFSYLIEKVKRKKNVLRLC (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRLC

SEQ ID NO: 349999 - protein, 21 aa, Artificial Sequence
  Description of Artificial Sequence: Synthetic peptide
  Seed: DELFSYLIEKVKRKKNVLRLC (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRLC

SEQ ID NO: 350000 - protein, 21 aa, Artificial Sequence
  Description of Artificial Sequence: Synthetic peptide
  Seed: DELFSYLIEKVKRKKNVLRLC (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRLC

SEQ ID NO: 350001 - protein, 21 aa, Artificial Sequence
  Description of Artificial Sequence: Synthetic peptide
  Seed: DELFSYLIEKVKRKKNVLRLC (PRAME_HUMAN)
  Core: VKRKKNVLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKXKRXKXVLXLC

SEQ ID NO: 350002 - protein, 21 aa, Artificial Sequence
  Description of Artificial Sequence: Synthetic peptide
  Seed: DELFSYLIEKVKRKKNVLRLC (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRXC

SEQ ID NO: 350003 - protein, 22 aa, Artificial Sequence
  Description of Artificial Sequence: Synthetic peptide
  Seed: DELFSYLIEKVKRKKNVLRLCC (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRLCC

SEQ ID NO: 350004 - protein, 22 aa, Artificial Sequence
  Description of Artificial Sequence: Synthetic peptide
  Seed: DELFSYLIEKVKRKKNVLRLCC (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRLCC

SEQ ID NO: 350005 - protein, 22 aa, Artificial Sequence
  Description of Artificial Sequence: Synthetic peptide
  Seed: DELFSYLIEKVKRKKNVLRLCC (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRLCC

SEQ ID NO: 350006 - protein, 22 aa, Artificial Sequence
  Description of Artificial Sequence: Synthetic peptide
  Seed: DELFSYLIEKVKRKKNVLRLCC (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRLCC

SEQ ID NO: 350007 - protein, 22 aa, Artificial Sequence
  Description of Artificial Sequence: Synthetic peptide
  Seed: DELFSYLIEKVKRKKNVLRLCC (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRXCC

SEQ ID NO: 350008 - protein, 23 aa, Artificial Sequence
  Description of Artificial Sequence: Synthetic peptide
  Seed: DELFSYLIEKVKRKKNVLRLCCK (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRLCCK

SEQ ID NO: 350009 - protein, 23 aa, Artificial Sequence
  Description of Artificial Sequence: Synthetic peptide
  Seed: DELFSYLIEKVKRKKNVLRLCCK (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRLCCK

SEQ ID NO: 350010 - protein, 23 aa, Artificial Sequence
  Description of Artificial Sequence: Synthetic peptide
  Seed: DELFSYLIEKVKRKKNVLRLCCK (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRLCCK

SEQ ID NO: 350011 - protein, 23 aa, Artificial Sequence
  Description of Artificial Sequence: Synthetic peptide
  Seed: DELFSYLIEKVKRKKNVLRLCCK (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRLCCK

SEQ ID NO: 350012 - protein, 23 aa, Artificial Sequence
  Description of Artificial Sequence: Synthetic peptide
  Seed: DELFSYLIEKVKRKKNVLRLCCK (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRXCCK

SEQ ID NO: 350013 - protein, 24 aa, Artificial Sequence
  Description of Artificial Sequence: Synthetic peptide
  Seed: DELFSYLIEKVKRKKNVLRLCCKK (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRLCCKK

SEQ ID NO: 350014 - protein, 24 aa, Artificial Sequence
  Description of Artificial Sequence: Synthetic peptide
  Seed: DELFSYLIEKVKRKKNVLRLCCKK (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRLCCKK

SEQ ID NO: 350015 - protein, 24 aa, Artificial Sequence
  Description of Artificial Sequence: Synthetic peptide
  Seed: DELFSYLIEKVKRKKNVLRLCCKK (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRLCCKK

SEQ ID NO: 350016 - protein, 24 aa, Artificial Sequence
  Description of Artificial Sequence: Synthetic peptide
  Seed: DELFSYLIEKVKRKKNVLRLCCKK (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRLCCKK

SEQ ID NO: 350017 - protein, 24 aa, Artificial Sequence
  Description of Artificial Sequence: Synthetic peptide
  Seed: DELFSYLIEKVKRKKNVLRLCCKK (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRXCCKK

SEQ ID NO: 350018 - protein, 24 aa, Artificial Sequence
  Description of Artificial Sequence: Synthetic peptide
  Seed: DELFSYLIEKVKRKKNVLRLCCKK (PRAME_HUMAN)
  Core: RKKNVLRLC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVKXKKXVXRLXCKK

SEQ ID NO: 350019 - protein, 25 aa, Artificial Sequence
  Description of Artificial Sequence: Synthetic peptide
  Seed: DELFSYLIEKVKRKKNVLRLCCKKL (PRAME_HUMAN)
  Core: LFSYLIEKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXFSXLXEKXKRKKNVLRLCCKKL

SEQ ID NO: 350020 - protein, 25 aa, Artificial Sequence
  Description of Artificial Sequence: Synthetic peptide
  Seed: DELFSYLIEKVKRKKNVLRLCCKKL (PRAME_HUMAN)
  Core: FSYLIEKVK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXSYXIXKVXRKKNVLRLCCKKL

SEQ ID NO: 350021 - protein, 25 aa, Artificial Sequence
  Description of Artificial Sequence: Synthetic peptide
  Seed: DELFSYLIEKVKRKKNVLRLCCKKL (PRAME_HUMAN)
  Core: YLIEKVKRK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELFSXLIXKXKRXKNVLRLCCKKL

SEQ ID NO: 350022 - protein, 25 aa, Artificial Sequence
  Description of Artificial Sequence: Synthetic peptide
  Seed: DELFSYLIEKVKRKKNVLRLCCKKL (PRAME_HUMAN)
  Core: IEKVKRKKN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLXEKXKXKKXVLRLCCKKL

SEQ ID NO: 350023 - protein, 25 aa, Artificial Sequence
  Description of Artificial Sequence: Synthetic peptide
  Seed: DELFSYLIEKVKRKKNVLRLCCKKL (PRAME_HUMAN)
  Core: KRKKNVLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVXRKXNXLRXCCKKL

SEQ ID NO: 350024 - protein, 25 aa, Artificial Sequence
  Description of Artificial Sequence: Synthetic peptide
  Seed: DELFSYLIEKVKRKKNVLRLCCKKL (PRAME_HUMAN)
  Core: RKKNVLRLC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DELFSYLIEKVKXKKXVXRLXCKKL

SEQ ID NO: 350025 - protein, 13 aa, Artificial Sequence
  Description of Artificial Sequence: Synthetic peptide
  Seed: DFWTVWSGNRASL (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSL

SEQ ID NO: 350026 - protein, 14 aa, Artificial Sequence
  Description of Artificial Sequence: Synthetic peptide
  Seed: DFWTVWSGNRASLY (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLY

SEQ ID NO: 350027 - protein, 14 aa, Artificial Sequence
  Description of Artificial Sequence: Synthetic peptide
  Seed: DFWTVWSGNRASLY (PRAME_HUMAN)
  Core: TVWSGNRAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DFWXVWXGXRAXLY

SEQ ID NO: 350028 - protein, 14 aa, Artificial Sequence
  Description of Artificial Sequence: Synthetic peptide
  Seed: DFWTVWSGNRASLY (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLX

SEQ ID NO: 350029 - protein, 15 aa, Artificial Sequence
  Description of Artificial Sequence: Synthetic peptide
  Seed: DFWTVWSGNRASLYS (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYS

SEQ ID NO: 350030 - protein, 15 aa, Artificial Sequence
  Description of Artificial Sequence: Synthetic peptide
  Seed: DFWTVWSGNRASLYS (PRAME_HUMAN)
  Core: TVWSGNRAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DFWXVWXGXRAXLYS

SEQ ID NO: 350031 - protein, 15 aa, Artificial Sequence
  Description of Artificial Sequence: Synthetic peptide
  Seed: DFWTVWSGNRASLYS (PRAME_HUMAN)
  Core: VWSGNRASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFWTXWSXNXASXYS

SEQ ID NO: 350032 - protein, 15 aa, Artificial Sequence
  Description of Artificial Sequence: Synthetic peptide
  Seed: DFWTVWSGNRASLYS (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXS

SEQ ID NO: 350033 - protein, 16 aa, Artificial Sequence
  Description of Artificial Sequence: Synthetic peptide
  Seed: DFWTVWSGNRASLYSF (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSF

SEQ ID NO: 350034 - protein, 16 aa, Artificial Sequence
  Description of Artificial Sequence: Synthetic peptide
  Seed: DFWTVWSGNRASLYSF (PRAME_HUMAN)
  Core: TVWSGNRAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DFWXVWXGXRAXLYSF

SEQ ID NO: 350035 - protein, 16 aa, Artificial Sequence
  Description of Artificial Sequence: Synthetic peptide
  Seed: DFWTVWSGNRASLYSF (PRAME_HUMAN)
  Core: VWSGNRASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFWTXWSXNXASXYSF

SEQ ID NO: 350036 - protein, 16 aa, Artificial Sequence
  Description of Artificial Sequence: Synthetic peptide
  Seed: DFWTVWSGNRASLYSF (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSF

SEQ ID NO: 350037 - protein, 17 aa, Artificial Sequence
  Description of Artificial Sequence: Synthetic peptide
  Seed: DFWTVWSGNRASLYSFP (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFP

SEQ ID NO: 350038 - protein, 17 aa, Artificial Sequence
  Description of Artificial Sequence: Synthetic peptide
  Seed: DFWTVWSGNRASLYSFP (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFP

SEQ ID NO: 350039 - protein, 18 aa, Artificial Sequence
  Description of Artificial Sequence: Synthetic peptide
  Seed: DFWTVWSGNRASLYSFPE (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFPE

SEQ ID NO: 350040 - protein, 18 aa, Artificial Sequence
  Description of Artificial Sequence: Synthetic peptide
  Seed: DFWTVWSGNRASLYSFPE (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPE

SEQ ID NO: 350041 - protein, 19 aa, Artificial Sequence
  Description of Artificial Sequence: Synthetic peptide
  Seed: DFWTVWSGNRASLYSFPEP (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFPEP

SEQ ID NO: 350042 - protein, 19 aa, Artificial Sequence
  Description of Artificial Sequence: Synthetic peptide
  Seed: DFWTVWSGNRASLYSFPEP (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEP

SEQ ID NO: 350043 - protein, 19 aa, Artificial Sequence
  Description of Artificial Sequence: Synthetic peptide
  Seed: DFWTVWSGNRASLYSFPEP (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXP

SEQ ID NO: 350044 - protein, 20 aa, Artificial Sequence
  Description of Artificial Sequence: Synthetic peptide
  Seed: DFWTVWSGNRASLYSFPEPE (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFPEPE

SEQ ID NO: 350045 - protein, 20 aa, Artificial Sequence
  Description of Artificial Sequence: Synthetic peptide
  Seed: DFWTVWSGNRASLYSFPEPE (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPE

SEQ ID NO: 350046 - protein, 20 aa, Artificial Sequence
  Description of Artificial Sequence: Synthetic peptide
  Seed: DFWTVWSGNRASLYSFPEPE (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPE

SEQ ID NO: 350047 - protein, 21 aa, Artificial Sequence
  Description of Artificial Sequence: Synthetic peptide
  Seed: DFWTVWSGNRASLYSFPEPEA (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFPEPEA

SEQ ID NO: 350048 - protein, 21 aa, Artificial Sequence
  Description of Artificial Sequence: Synthetic peptide
  Seed: DFWTVWSGNRASLYSFPEPEA (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPEA

SEQ ID NO: 350049 - protein, 21 aa, Artificial Sequence
  Description of Artificial Sequence: Synthetic peptide
  Seed: DFWTVWSGNRASLYSFPEPEA (PRAME_HUMAN)
  Core: NRASLYSFP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGXRAXLXSFXEPEA

SEQ ID NO: 350050 - protein, 21 aa, Artificial Sequence
  Description of Artificial Sequence: Synthetic peptide
  Seed: DFWTVWSGNRASLYSFPEPEA (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPEA

SEQ ID NO: 350051 - protein, 21 aa, Artificial Sequence
  Description of Artificial Sequence: Synthetic peptide
  Seed: DFWTVWSGNRASLYSFPEPEA (PRAME_HUMAN)
  Core: SLYSFPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRAXLYXFXEPXA

SEQ ID NO: 350052 - protein, 22 aa, Artificial Sequence
  Description of Artificial Sequence: Synthetic peptide
  Seed: DFWTVWSGNRASLYSFPEPEAA (PRAME_HUMAN)
  Core: WTVWSGNRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DFXTVXSXNRXSLYSFPEPEAA

SEQ ID NO: 350053 - protein, 22 aa, Artificial Sequence
  Description of Artificial Sequence: Synthetic peptide
  Seed: DFWTVWSGNRASLYSFPEPEAA (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPEAA

SEQ ID NO: 350054 - protein, 22 aa, Artificial Sequence
  Description of Artificial Sequence: Synthetic peptide
  Seed: DFWTVWSGNRASLYSFPEPEAA (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPEAA

SEQ ID NO: 350055 - protein, 22 aa, Artificial Sequence
  Description of Artificial Sequence: Synthetic peptide
  Seed: DFWTVWSGNRASLYSFPEPEAA (PRAME_HUMAN)
  Core: SLYSFPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRAXLYXFXEPXAA

SEQ ID NO: 350056 - protein, 22 aa, Artificial Sequence
  Description of Artificial Sequence: Synthetic peptide
  Seed: DFWTVWSGNRASLYSFPEPEAA (PRAME_HUMAN)
  Core: LYSFPEPEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASXYSXPXPEXA

SEQ ID NO: 350057 - protein, 23 aa, Artificial Sequence
  Description of Artificial Sequence: Synthetic peptide
  Seed: DFWTVWSGNRASLYSFPEPEAAQ (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPEAAQ

SEQ ID NO: 350058 - protein, 23 aa, Artificial Sequence
  Description of Artificial Sequence: Synthetic peptide
  Seed: DFWTVWSGNRASLYSFPEPEAAQ (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPEAAQ

SEQ ID NO: 350059 - protein, 23 aa, Artificial Sequence
  Description of Artificial Sequence: Synthetic peptide
  Seed: DFWTVWSGNRASLYSFPEPEAAQ (PRAME_HUMAN)
  Core: SLYSFPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRAXLYXFXEPXAAQ

SEQ ID NO: 350060 - protein, 23 aa, Artificial Sequence
  Description of Artificial Sequence: Synthetic peptide
  Seed: DFWTVWSGNRASLYSFPEPEAAQ (PRAME_HUMAN)
  Core: LYSFPEPEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASXYSXPXPEXAQ

SEQ ID NO: 350061 - protein, 23 aa, Artificial Sequence
  Description of Artificial Sequence: Synthetic peptide
  Seed: DFWTVWSGNRASLYSFPEPEAAQ (PRAME_HUMAN)
  Core: YSFPEPEAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASLXSFXEXEAXQ

SEQ ID NO: 350062 - protein, 24 aa, Artificial Sequence
  Description of Artificial Sequence: Synthetic peptide
  Seed: DFWTVWSGNRASLYSFPEPEAAQP (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPEAAQP

SEQ ID NO: 350063 - protein, 24 aa, Artificial Sequence
  Description of Artificial Sequence: Synthetic peptide
  Seed: DFWTVWSGNRASLYSFPEPEAAQP (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPEAAQP

SEQ ID NO: 350064 - protein, 24 aa, Artificial Sequence
  Description of Artificial Sequence: Synthetic peptide
  Seed: DFWTVWSGNRASLYSFPEPEAAQP (PRAME_HUMAN)
  Core: SLYSFPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRAXLYXFXEPXAAQP

SEQ ID NO: 350065 - protein, 24 aa, Artificial Sequence
  Description of Artificial Sequence: Synthetic peptide
  Seed: DFWTVWSGNRASLYSFPEPEAAQP (PRAME_HUMAN)
  Core: LYSFPEPEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASXYSXPXPEXAQP

SEQ ID NO: 350066 - protein, 24 aa, Artificial Sequence
  Description of Artificial Sequence: Synthetic peptide
  Seed: DFWTVWSGNRASLYSFPEPEAAQP (PRAME_HUMAN)
  Core: YSFPEPEAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASLXSFXEXEAXQP

SEQ ID NO: 350067 - protein, 25 aa, Artificial Sequence
  Description of Artificial Sequence: Synthetic peptide
  Seed: DFWTVWSGNRASLYSFPEPEAAQPM (PRAME_HUMAN)
  Core: WSGNRASLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVXSGXRXSLXSFPEPEAAQPM

SEQ ID NO: 350068 - protein, 25 aa, Artificial Sequence
  Description of Artificial Sequence: Synthetic peptide
  Seed: DFWTVWSGNRASLYSFPEPEAAQPM (PRAME_HUMAN)
  Core: RASLYSFPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNXASXYXFPXPEAAQPM

SEQ ID NO: 350069 - protein, 25 aa, Artificial Sequence
  Description of Artificial Sequence: Synthetic peptide
  Seed: DFWTVWSGNRASLYSFPEPEAAQPM (PRAME_HUMAN)
  Core: SLYSFPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRAXLYXFXEPXAAQPM

SEQ ID NO: 350070 - protein, 25 aa, Artificial Sequence
  Description of Artificial Sequence: Synthetic peptide
  Seed: DFWTVWSGNRASLYSFPEPEAAQPM (PRAME_HUMAN)
  Core: LYSFPEPEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASXYSXPXPEXAQPM

SEQ ID NO: 350071 - protein, 25 aa, Artificial Sequence
  Description of Artificial Sequence: Synthetic peptide
  Seed: DFWTVWSGNRASLYSFPEPEAAQPM (PRAME_HUMAN)
  Core: YSFPEPEAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DFWTVWSGNRASLXSFXEXEAXQPM

SEQ ID NO: 350072 - protein, 13 aa, Artificial Sequence
  Description of Artificial Sequence: Synthetic peptide
  Seed: DGLDVLLAQEVRP (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRP

SEQ ID NO: 350073 - protein, 14 aa, Artificial Sequence
  Description of Artificial Sequence: Synthetic peptide
  Seed: DGLDVLLAQEVRPR (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPR

SEQ ID NO: 350074 - protein, 15 aa, Artificial Sequence
  Description of Artificial Sequence: Synthetic peptide
  Seed: DGLDVLLAQEVRPRR (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRR

SEQ ID NO: 350075 - protein, 15 aa, Artificial Sequence
  Description of Artificial Sequence: Synthetic peptide
  Seed: DGLDVLLAQEVRPRR (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXR

SEQ ID NO: 350076 - protein, 15 aa, Artificial Sequence
  Description of Artificial Sequence: Synthetic peptide
  Seed: DGLDVLLAQEVRPRR (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRX

SEQ ID NO: 350077 - protein, 16 aa, Artificial Sequence
  Description of Artificial Sequence: Synthetic peptide
  Seed: DGLDVLLAQEVRPRRW (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRW

SEQ ID NO: 350078 - protein, 16 aa, Artificial Sequence
  Description of Artificial Sequence: Synthetic peptide
  Seed: DGLDVLLAQEVRPRRW (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRW

SEQ ID NO: 350079 - protein, 16 aa, Artificial Sequence
  Description of Artificial Sequence: Synthetic peptide
  Seed: DGLDVLLAQEVRPRRW (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXW

SEQ ID NO: 350080 - protein, 17 aa, Artificial Sequence
  Description of Artificial Sequence: Synthetic peptide
  Seed: DGLDVLLAQEVRPRRWK (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWK

SEQ ID NO: 350081 - protein, 17 aa, Artificial Sequence
  Description of Artificial Sequence: Synthetic peptide
  Seed: DGLDVLLAQEVRPRRWK (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWK

SEQ ID NO: 350082 - protein, 17 aa, Artificial Sequence
  Description of Artificial Sequence: Synthetic peptide
  Seed: DGLDVLLAQEVRPRRWK (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWK

SEQ ID NO: 350083 - protein, 18 aa, Artificial Sequence
  Description of Artificial Sequence: Synthetic peptide
  Seed: DGLDVLLAQEVRPRRWKL (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKL

SEQ ID NO: 350084 - protein, 18 aa, Artificial Sequence
  Description of Artificial Sequence: Synthetic peptide
  Seed: DGLDVLLAQEVRPRRWKL (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKL

SEQ ID NO: 350085 - protein, 18 aa, Artificial Sequence
  Description of Artificial Sequence: Synthetic peptide
  Seed: DGLDVLLAQEVRPRRWKL (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKL

SEQ ID NO: 350086 - protein, 19 aa, Artificial Sequence
  Description of Artificial Sequence: Synthetic peptide
  Seed: DGLDVLLAQEVRPRRWKLQ (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQ

SEQ ID NO: 350087 - protein, 19 aa, Artificial Sequence
  Description of Artificial Sequence: Synthetic peptide
  Seed: DGLDVLLAQEVRPRRWKLQ (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQ

SEQ ID NO: 350088 - protein, 19 aa, Artificial Sequence
  Description of Artificial Sequence: Synthetic peptide
  Seed: DGLDVLLAQEVRPRRWKLQ (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQ

SEQ ID NO: 350089 - protein, 20 aa, Artificial Sequence
  Description of Artificial Sequence: Synthetic peptide
  Seed: DGLDVLLAQEVRPRRWKLQV (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQV

SEQ ID NO: 350090 - protein, 20 aa, Artificial Sequence
  Description of Artificial Sequence: Synthetic peptide
  Seed: DGLDVLLAQEVRPRRWKLQV (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQV

SEQ ID NO: 350091 - protein, 20 aa, Artificial Sequence
  Description of Artificial Sequence: Synthetic peptide
  Seed: DGLDVLLAQEVRPRRWKLQV (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQV

SEQ ID NO: 350092 - protein, 21 aa, Artificial Sequence
  Description of Artificial Sequence: Synthetic peptide
  Seed: DGLDVLLAQEVRPRRWKLQVL (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQVL

SEQ ID NO: 350093 - protein, 21 aa, Artificial Sequence
  Description of Artificial Sequence: Synthetic peptide
  Seed: DGLDVLLAQEVRPRRWKLQVL (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQVL

SEQ ID NO: 350094 - protein, 21 aa, Artificial Sequence
  Description of Artificial Sequence: Synthetic peptide
  Seed: DGLDVLLAQEVRPRRWKLQVL (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQVL

SEQ ID NO: 350095 - protein, 22 aa, Artificial Sequence
  Description of Artificial Sequence: Synthetic peptide
  Seed: DGLDVLLAQEVRPRRWKLQVLD (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQVLD

SEQ ID NO: 350096 - protein, 22 aa, Artificial Sequence
  Description of Artificial Sequence: Synthetic peptide
  Seed: DGLDVLLAQEVRPRRWKLQVLD (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQVLD

SEQ ID NO: 350097 - protein, 22 aa, Artificial Sequence
  Description of Artificial Sequence: Synthetic peptide
  Seed: DGLDVLLAQEVRPRRWKLQVLD (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQVLD

SEQ ID NO: 350098 - protein, 22 aa, Artificial Sequence
  Description of Artificial Sequence: Synthetic peptide
  Seed: DGLDVLLAQEVRPRRWKLQVLD (PRAME_HUMAN)
  Core: PRRWKLQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRXRRXKXQVXD

SEQ ID NO: 350099 - protein, 22 aa, Artificial Sequence
  Description of Artificial Sequence: Synthetic peptide
  Seed: DGLDVLLAQEVRPRRWKLQVLD (PRAME_HUMAN)
  Core: RRWKLQVLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPXRWXLXVLX

SEQ ID NO: 350100 - protein, 23 aa, Artificial Sequence
  Description of Artificial Sequence: Synthetic peptide
  Seed: DGLDVLLAQEVRPRRWKLQVLDL (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQVLDL

SEQ ID NO: 350101 - protein, 23 aa, Artificial Sequence
  Description of Artificial Sequence: Synthetic peptide
  Seed: DGLDVLLAQEVRPRRWKLQVLDL (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQVLDL

SEQ ID NO: 350102 - protein, 23 aa, Artificial Sequence
  Description of Artificial Sequence: Synthetic peptide
  Seed: DGLDVLLAQEVRPRRWKLQVLDL (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQVLDL

SEQ ID NO: 350103 - protein, 23 aa, Artificial Sequence
  Description of Artificial Sequence: Synthetic peptide
  Seed: DGLDVLLAQEVRPRRWKLQVLDL (PRAME_HUMAN)
  Core: VRPRRWKLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEXRPXRXKLXVLDL

SEQ ID NO: 350104 - protein, 23 aa, Artificial Sequence
  Description of Artificial Sequence: Synthetic peptide
  Seed: DGLDVLLAQEVRPRRWKLQVLDL (PRAME_HUMAN)
  Core: PRRWKLQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRXRRXKXQVXDL

SEQ ID NO: 350105 - protein, 23 aa, Artificial Sequence
  Description of Artificial Sequence: Synthetic peptide
  Seed: DGLDVLLAQEVRPRRWKLQVLDL (PRAME_HUMAN)
  Core: RRWKLQVLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPXRWXLXVLXL

SEQ ID NO: 350106 - protein, 24 aa, Artificial Sequence
  Description of Artificial Sequence: Synthetic peptide
  Seed: DGLDVLLAQEVRPRRWKLQVLDLR (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQVLDLR

SEQ ID NO: 350107 - protein, 24 aa, Artificial Sequence
  Description of Artificial Sequence: Synthetic peptide
  Seed: DGLDVLLAQEVRPRRWKLQVLDLR (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQVLDLR

SEQ ID NO: 350108 - protein, 24 aa, Artificial Sequence
  Description of Artificial Sequence: Synthetic peptide
  Seed: DGLDVLLAQEVRPRRWKLQVLDLR (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQVLDLR

SEQ ID NO: 350109 - protein, 24 aa, Artificial Sequence
  Description of Artificial Sequence: Synthetic peptide
  Seed: DGLDVLLAQEVRPRRWKLQVLDLR (PRAME_HUMAN)
  Core: VRPRRWKLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEXRPXRXKLXVLDLR

SEQ ID NO: 350110 - protein, 24 aa, Artificial Sequence
  Description of Artificial Sequence: Synthetic peptide
  Seed: DGLDVLLAQEVRPRRWKLQVLDLR (PRAME_HUMAN)
  Core: PRRWKLQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRXRRXKXQVXDLR

SEQ ID NO: 350111 - protein, 24 aa, Artificial Sequence
  Description of Artificial Sequence: Synthetic peptide
  Seed: DGLDVLLAQEVRPRRWKLQVLDLR (PRAME_HUMAN)
  Core: RRWKLQVLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPXRWXLXVLXLR

SEQ ID NO: 350112 - protein, 24 aa, Artificial Sequence
  Description of Artificial Sequence: Synthetic peptide
  Seed: DGLDVLLAQEVRPRRWKLQVLDLR (PRAME_HUMAN)
  Core: RWKLQVLDL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPRXWKXQXLDXR

SEQ ID NO: 350113 - protein, 25 aa, Artificial Sequence
  Description of Artificial Sequence: Synthetic peptide
  Seed: DGLDVLLAQEVRPRRWKLQVLDLRK (PRAME_HUMAN)
  Core: LDVLLAQEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXDVXLXQEXRPRRWKLQVLDLRK

SEQ ID NO: 350114 - protein, 25 aa, Artificial Sequence
  Description of Artificial Sequence: Synthetic peptide
  Seed: DGLDVLLAQEVRPRRWKLQVLDLRK (PRAME_HUMAN)
  Core: LLAQEVRPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVXLAXEXRPXRWKLQVLDLRK

SEQ ID NO: 350115 - protein, 25 aa, Artificial Sequence
  Description of Artificial Sequence: Synthetic peptide
  Seed: DGLDVLLAQEVRPRRWKLQVLDLRK (PRAME_HUMAN)
  Core: LAQEVRPRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLXAQXVXPRXWKLQVLDLRK

SEQ ID NO: 350116 - protein, 25 aa, Artificial Sequence
  Description of Artificial Sequence: Synthetic peptide
  Seed: DGLDVLLAQEVRPRRWKLQVLDLRK (PRAME_HUMAN)
  Core: VRPRRWKLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEXRPXRXKLXVLDLRK

SEQ ID NO: 350117 - protein, 25 aa, Artificial Sequence
  Description of Artificial Sequence: Synthetic peptide
  Seed: DGLDVLLAQEVRPRRWKLQVLDLRK (PRAME_HUMAN)
  Core: PRRWKLQVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRXRRXKXQVXDLRK

SEQ ID NO: 350118 - protein, 25 aa, Artificial Sequence
  Description of Artificial Sequence: Synthetic peptide
  Seed: DGLDVLLAQEVRPRRWKLQVLDLRK (PRAME_HUMAN)
  Core: RRWKLQVLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPXRWXLXVLXLRK

SEQ ID NO: 350119 - protein, 25 aa, Artificial Sequence
  Description of Artificial Sequence: Synthetic peptide
  Seed: DGLDVLLAQEVRPRRWKLQVLDLRK (PRAME_HUMAN)
  Core: RWKLQVLDL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPRXWKXQXLDXRK

SEQ ID NO: 350120 - protein, 25 aa, Artificial Sequence
  Description of Artificial Sequence: Synthetic peptide
  Seed: DGLDVLLAQEVRPRRWKLQVLDLRK (PRAME_HUMAN)
  Core: WKLQVLDLR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DGLDVLLAQEVRPRRXKLXVXDLXK

SEQ ID NO: 350121 - protein, 13 aa, Artificial Sequence
  Description of Artificial Sequence: Synthetic peptide
  Seed: DGLSTEAEQPFIP (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIP

SEQ ID NO: 350122 - protein, 14 aa, Artificial Sequence
  Description of Artificial Sequence: Synthetic peptide
  Seed: DGLSTEAEQPFIPV (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPV

SEQ ID NO: 350123 - protein, 15 aa, Artificial Sequence
  Description of Artificial Sequence: Synthetic peptide
  Seed: DGLSTEAEQPFIPVE (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVE

SEQ ID NO: 350124 - protein, 16 aa, Artificial Sequence
  Description of Artificial Sequence: Synthetic peptide
  Seed: DGLSTEAEQPFIPVEV (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEV

SEQ ID NO: 350125 - protein, 17 aa, Artificial Sequence
  Description of Artificial Sequence: Synthetic peptide
  Seed: DGLSTEAEQPFIPVEVL (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVL

SEQ ID NO: 350126 - protein, 17 aa, Artificial Sequence
  Description of Artificial Sequence: Synthetic peptide
  Seed: DGLSTEAEQPFIPVEVL (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVL

SEQ ID NO: 350127 - protein, 18 aa, Artificial Sequence
  Description of Artificial Sequence: Synthetic peptide
  Seed: DGLSTEAEQPFIPVEVLV (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLV

SEQ ID NO: 350128 - protein, 19 aa, Artificial Sequence
  Description of Artificial Sequence: Synthetic peptide
  Seed: DGLSTEAEQPFIPVEVLVD (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVD

SEQ ID NO: 350129 - protein, 19 aa, Artificial Sequence
  Description of Artificial Sequence: Synthetic peptide
  Seed: DGLSTEAEQPFIPVEVLVD (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVLVD

SEQ ID NO: 350130 - protein, 19 aa, Artificial Sequence
  Description of Artificial Sequence: Synthetic peptide
  Seed: DGLSTEAEQPFIPVEVLVD (PRAME_HUMAN)
  Core: EQPFIPVEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAXQPXIXVEXLVD

SEQ ID NO: 350131 - protein, 19 aa, Artificial Sequence
  Description of Artificial Sequence: Synthetic peptide
  Seed: DGLSTEAEQPFIPVEVLVD (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVX

SEQ ID NO: 350132 - protein, 20 aa, Artificial Sequence
  Description of Artificial Sequence: Synthetic peptide
  Seed: DGLSTEAEQPFIPVEVLVDL (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDL

SEQ ID NO: 350133 - protein, 20 aa, Artificial Sequence
  Description of Artificial Sequence: Synthetic peptide
  Seed: DGLSTEAEQPFIPVEVLVDL (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVLVDL

SEQ ID NO: 350134 - protein, 20 aa, Artificial Sequence
  Description of Artificial Sequence: Synthetic peptide
  Seed: DGLSTEAEQPFIPVEVLVDL (PRAME_HUMAN)
  Core: EQPFIPVEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAXQPXIXVEXLVDL

SEQ ID NO: 350135 - protein, 20 aa, Artificial Sequence
  Description of Artificial Sequence: Synthetic peptide
  Seed: DGLSTEAEQPFIPVEVLVDL (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXL

SEQ ID NO: 350136 - protein, 21 aa, Artificial Sequence
  Description of Artificial Sequence: Synthetic peptide
  Seed: DGLSTEAEQPFIPVEVLVDLF (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDLF

SEQ ID NO: 350137 - protein, 21 aa, Artificial Sequence
  Description of Artificial Sequence: Synthetic peptide
  Seed: DGLSTEAEQPFIPVEVLVDLF (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXLF

SEQ ID NO: 350138 - protein, 22 aa, Artificial Sequence
  Description of Artificial Sequence: Synthetic peptide
  Seed: DGLSTEAEQPFIPVEVLVDLFL (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDLFL

SEQ ID NO: 350139 - protein, 22 aa, Artificial Sequence
  Description of Artificial Sequence: Synthetic peptide
  Seed: DGLSTEAEQPFIPVEVLVDLFL (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXLFL

SEQ ID NO: 350140 - protein, 23 aa, Artificial Sequence
  Description of Artificial Sequence: Synthetic peptide
  Seed: DGLSTEAEQPFIPVEVLVDLFLK (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDLFLK

SEQ ID NO: 350141 - protein, 23 aa, Artificial Sequence
  Description of Artificial Sequence: Synthetic peptide
  Seed: DGLSTEAEQPFIPVEVLVDLFLK (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVLVDLFLK

SEQ ID NO: 350142 - protein, 23 aa, Artificial Sequence
  Description of Artificial Sequence: Synthetic peptide
  Seed: DGLSTEAEQPFIPVEVLVDLFLK (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXLFLK

SEQ ID NO: 350143 - protein, 24 aa, Artificial Sequence
  Description of Artificial Sequence: Synthetic peptide
  Seed: DGLSTEAEQPFIPVEVLVDLFLKE (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDLFLKE

SEQ ID NO: 350144 - protein, 24 aa, Artificial Sequence
  Description of Artificial Sequence: Synthetic peptide
  Seed: DGLSTEAEQPFIPVEVLVDLFLKE (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVLVDLFLKE

SEQ ID NO: 350145 - protein, 24 aa, Artificial Sequence
  Description of Artificial Sequence: Synthetic peptide
  Seed: DGLSTEAEQPFIPVEVLVDLFLKE (PRAME_HUMAN)
  Core: EQPFIPVEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAXQPXIXVEXLVDLFLKE

SEQ ID NO: 350146 - protein, 24 aa, Artificial Sequence
  Description of Artificial Sequence: Synthetic peptide
  Seed: DGLSTEAEQPFIPVEVLVDLFLKE (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXLFLKE

SEQ ID NO: 350147 - protein, 25 aa, Artificial Sequence
  Description of Artificial Sequence: Synthetic peptide
  Seed: DGLSTEAEQPFIPVEVLVDLFLKEG (PRAME_HUMAN)
  Core: LSTEAEQPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXSTXAXQPXIPVEVLVDLFLKEG

SEQ ID NO: 350148 - protein, 25 aa, Artificial Sequence
  Description of Artificial Sequence: Synthetic peptide
  Seed: DGLSTEAEQPFIPVEVLVDLFLKEG (PRAME_HUMAN)
  Core: EAEQPFIPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTXAEXPXIPXEVLVDLFLKEG

SEQ ID NO: 350149 - protein, 25 aa, Artificial Sequence
  Description of Artificial Sequence: Synthetic peptide
  Seed: DGLSTEAEQPFIPVEVLVDLFLKEG (PRAME_HUMAN)
  Core: EQPFIPVEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAXQPXIXVEXLVDLFLKEG

SEQ ID NO: 350150 - protein, 25 aa, Artificial Sequence
  Description of Artificial Sequence: Synthetic peptide
  Seed: DGLSTEAEQPFIPVEVLVDLFLKEG (PRAME_HUMAN)
  Core: FIPVEVLVD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPXIPXEXLVXLFLKEG

SEQ ID NO: 350151 - protein, 25 aa, Artificial Sequence
  Description of Artificial Sequence: Synthetic peptide
  Seed: DGLSTEAEQPFIPVEVLVDLFLKEG (PRAME_HUMAN)
  Core: VLVDLFLKE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DGLSTEAEQPFIPVEXLVXLXLKXG

SEQ ID NO: 350152 - protein, 14 aa, Artificial Sequence
  Description of Artificial Sequence: Synthetic peptide
  Seed: DGRHSQTLKAMVQA (PRAME_HUMAN)
  Core: GRHSQTLKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRHXQXLKXMVQA

SEQ ID NO: 350153 - protein, 15 aa, Artificial Sequence
  Description of Artificial Sequence: Synthetic peptide
  Seed: DGRHSQTLKAMVQAW (PRAME_HUMAN)
  Core: GRHSQTLKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRHXQXLKXMVQAW

SEQ ID NO: 350154 - protein, 15 aa, Artificial Sequence
  Description of Artificial Sequence: Synthetic peptide
  Seed: DGRHSQTLKAMVQAW (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAW

SEQ ID NO: 350155 - protein, 16 aa, Artificial Sequence
  Description of Artificial Sequence: Synthetic peptide
  Seed: DGRHSQTLKAMVQAWP (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWP

SEQ ID NO: 350156 - protein, 17 aa, Artificial Sequence
  Description of Artificial Sequence: Synthetic peptide
  Seed: DGRHSQTLKAMVQAWPF (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPF

SEQ ID NO: 350157 - protein, 17 aa, Artificial Sequence
  Description of Artificial Sequence: Synthetic peptide
  Seed: DGRHSQTLKAMVQAWPF (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPF

SEQ ID NO: 350158 - protein, 17 aa, Artificial Sequence
  Description of Artificial Sequence: Synthetic peptide
  Seed: DGRHSQTLKAMVQAWPF (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXF

SEQ ID NO: 350159 - protein, 17 aa, Artificial Sequence
  Description of Artificial Sequence: Synthetic peptide
  Seed: DGRHSQTLKAMVQAWPF (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPX

SEQ ID NO: 350160 - protein, 18 aa, Artificial Sequence
  Description of Artificial Sequence: Synthetic peptide
  Seed: DGRHSQTLKAMVQAWPFT (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFT

SEQ ID NO: 350161 - protein, 19 aa, Artificial Sequence
  Description of Artificial Sequence: Synthetic peptide
  Seed: DGRHSQTLKAMVQAWPFTC (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTC

SEQ ID NO: 350162 - protein, 19 aa, Artificial Sequence
  Description of Artificial Sequence: Synthetic peptide
  Seed: DGRHSQTLKAMVQAWPFTC (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTC

SEQ ID NO: 350163 - protein, 19 aa, Artificial Sequence
  Description of Artificial Sequence: Synthetic peptide
  Seed: DGRHSQTLKAMVQAWPFTC (PRAME_HUMAN)
  Core: QTLKAMVQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSXTLXAXVQXWPFTC

SEQ ID NO: 350164 - protein, 19 aa, Artificial Sequence
  Description of Artificial Sequence: Synthetic peptide
  Seed: DGRHSQTLKAMVQAWPFTC (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTC

SEQ ID NO: 350165 - protein, 20 aa, Artificial Sequence
  Description of Artificial Sequence: Synthetic peptide
  Seed: DGRHSQTLKAMVQAWPFTCL (PRAME_HUMAN)
  Core: GRHSQTLKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRHXQXLKXMVQAWPFTCL

SEQ ID NO: 350166 - protein, 20 aa, Artificial Sequence
  Description of Artificial Sequence: Synthetic peptide
  Seed: DGRHSQTLKAMVQAWPFTCL (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCL

SEQ ID NO: 350167 - protein, 20 aa, Artificial Sequence
  Description of Artificial Sequence: Synthetic peptide
  Seed: DGRHSQTLKAMVQAWPFTCL (PRAME_HUMAN)
  Core: HSQTLKAMV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DGRXSQXLXAMXQAWPFTCL

SEQ ID NO: 350168 - protein, 20 aa, Artificial Sequence
  Description of Artificial Sequence: Synthetic peptide
  Seed: DGRHSQTLKAMVQAWPFTCL (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCL

SEQ ID NO: 350169 - protein, 20 aa, Artificial Sequence
  Description of Artificial Sequence: Synthetic peptide
  Seed: DGRHSQTLKAMVQAWPFTCL (PRAME_HUMAN)
  Core: QTLKAMVQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSXTLXAXVQXWPFTCL

SEQ ID NO: 350170 - protein, 20 aa, Artificial Sequence
  Description of Artificial Sequence: Synthetic peptide
  Seed: DGRHSQTLKAMVQAWPFTCL (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCL

SEQ ID NO: 350171 - protein, 20 aa, Artificial Sequence
  Description of Artificial Sequence: Synthetic peptide
  Seed: DGRHSQTLKAMVQAWPFTCL (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPXTCL

SEQ ID NO: 350172 - protein, 20 aa, Artificial Sequence
  Description of Artificial Sequence: Synthetic peptide
  Seed: DGRHSQTLKAMVQAWPFTCL (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCX

SEQ ID NO: 350173 - protein, 21 aa, Artificial Sequence
  Description of Artificial Sequence: Synthetic peptide
  Seed: DGRHSQTLKAMVQAWPFTCLP (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCLP

SEQ ID NO: 350174 - protein, 21 aa, Artificial Sequence
  Description of Artificial Sequence: Synthetic peptide
  Seed: DGRHSQTLKAMVQAWPFTCLP (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCLP

SEQ ID NO: 350175 - protein, 21 aa, Artificial Sequence
  Description of Artificial Sequence: Synthetic peptide
  Seed: DGRHSQTLKAMVQAWPFTCLP (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCLP

SEQ ID NO: 350176 - protein, 21 aa, Artificial Sequence
  Description of Artificial Sequence: Synthetic peptide
  Seed: DGRHSQTLKAMVQAWPFTCLP (PRAME_HUMAN)
  Core: MVQAWPFTC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAXVQXWXFTXLP

SEQ ID NO: 350177 - protein, 21 aa, Artificial Sequence
  Description of Artificial Sequence: Synthetic peptide
  Seed: DGRHSQTLKAMVQAWPFTCLP (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCXP

SEQ ID NO: 350178 - protein, 22 aa, Artificial Sequence
  Description of Artificial Sequence: Synthetic peptide
  Seed: DGRHSQTLKAMVQAWPFTCLPL (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCLPL

SEQ ID NO: 350179 - protein, 22 aa, Artificial Sequence
  Description of Artificial Sequence: Synthetic peptide
  Seed: DGRHSQTLKAMVQAWPFTCLPL (PRAME_HUMAN)
  Core: HSQTLKAMV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DGRXSQXLXAMXQAWPFTCLPL

SEQ ID NO: 350180 - protein, 22 aa, Artificial Sequence
  Description of Artificial Sequence: Synthetic peptide
  Seed: DGRHSQTLKAMVQAWPFTCLPL (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCLPL

SEQ ID NO: 350181 - protein, 22 aa, Artificial Sequence
  Description of Artificial Sequence: Synthetic peptide
  Seed: DGRHSQTLKAMVQAWPFTCLPL (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCLPL

SEQ ID NO: 350182 - protein, 22 aa, Artificial Sequence
  Description of Artificial Sequence: Synthetic peptide
  Seed: DGRHSQTLKAMVQAWPFTCLPL (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPXTCLPL

SEQ ID NO: 350183 - protein, 22 aa, Artificial Sequence
  Description of Artificial Sequence: Synthetic peptide
  Seed: DGRHSQTLKAMVQAWPFTCLPL (PRAME_HUMAN)
  Core: MVQAWPFTC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAXVQXWXFTXLPL

SEQ ID NO: 350184 - protein, 22 aa, Artificial Sequence
  Description of Artificial Sequence: Synthetic peptide
  Seed: DGRHSQTLKAMVQAWPFTCLPL (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCXPL

SEQ ID NO: 350185 - protein, 23 aa, Artificial Sequence
  Description of Artificial Sequence: Synthetic peptide
  Seed: DGRHSQTLKAMVQAWPFTCLPLG (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCLPLG

SEQ ID NO: 350186 - protein, 23 aa, Artificial Sequence
  Description of Artificial Sequence: Synthetic peptide
  Seed: DGRHSQTLKAMVQAWPFTCLPLG (PRAME_HUMAN)
  Core: HSQTLKAMV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DGRXSQXLXAMXQAWPFTCLPLG

SEQ ID NO: 350187 - protein, 23 aa, Artificial Sequence
  Description of Artificial Sequence: Synthetic peptide
  Seed: DGRHSQTLKAMVQAWPFTCLPLG (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCLPLG

SEQ ID NO: 350188 - protein, 23 aa, Artificial Sequence
  Description of Artificial Sequence: Synthetic peptide
  Seed: DGRHSQTLKAMVQAWPFTCLPLG (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCLPLG

SEQ ID NO: 350189 - protein, 23 aa, Artificial Sequence
  Description of Artificial Sequence: Synthetic peptide
  Seed: DGRHSQTLKAMVQAWPFTCLPLG (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPXTCLPLG

SEQ ID NO: 350190 - protein, 23 aa, Artificial Sequence
  Description of Artificial Sequence: Synthetic peptide
  Seed: DGRHSQTLKAMVQAWPFTCLPLG (PRAME_HUMAN)
  Core: MVQAWPFTC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAXVQXWXFTXLPLG

SEQ ID NO: 350191 - protein, 23 aa, Artificial Sequence
  Description of Artificial Sequence: Synthetic peptide
  Seed: DGRHSQTLKAMVQAWPFTCLPLG (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCXPLG

SEQ ID NO: 350192 - protein, 24 aa, Artificial Sequence
  Description of Artificial Sequence: Synthetic peptide
  Seed: DGRHSQTLKAMVQAWPFTCLPLGV (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCLPLGV

SEQ ID NO: 350193 - protein, 24 aa, Artificial Sequence
  Description of Artificial Sequence: Synthetic peptide
  Seed: DGRHSQTLKAMVQAWPFTCLPLGV (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCLPLGV

SEQ ID NO: 350194 - protein, 24 aa, Artificial Sequence
  Description of Artificial Sequence: Synthetic peptide
  Seed: DGRHSQTLKAMVQAWPFTCLPLGV (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCLPLGV

SEQ ID NO: 350195 - protein, 24 aa, Artificial Sequence
  Description of Artificial Sequence: Synthetic peptide
  Seed: DGRHSQTLKAMVQAWPFTCLPLGV (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPXTCLPLGV

SEQ ID NO: 350196 - protein, 24 aa, Artificial Sequence
  Description of Artificial Sequence: Synthetic peptide
  Seed: DGRHSQTLKAMVQAWPFTCLPLGV (PRAME_HUMAN)
  Core: MVQAWPFTC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAXVQXWXFTXLPLGV

SEQ ID NO: 350197 - protein, 24 aa, Artificial Sequence
  Description of Artificial Sequence: Synthetic peptide
  Seed: DGRHSQTLKAMVQAWPFTCLPLGV (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCXPLGV

SEQ ID NO: 350198 - protein, 25 aa, Artificial Sequence
  Description of Artificial Sequence: Synthetic peptide
  Seed: DGRHSQTLKAMVQAWPFTCLPLGVL (PRAME_HUMAN)
  Core: RHSQTLKAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DGXHSXTXKAXVQAWPFTCLPLGVL

SEQ ID NO: 350199 - protein, 25 aa, Artificial Sequence
  Description of Artificial Sequence: Synthetic peptide
  Seed: DGRHSQTLKAMVQAWPFTCLPLGVL (PRAME_HUMAN)
  Core: SQTLKAMVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DGRHXQTXKXMVXAWPFTCLPLGVL

SEQ ID NO: 350200 - protein, 25 aa, Artificial Sequence
  Description of Artificial Sequence: Synthetic peptide
  Seed: DGRHSQTLKAMVQAWPFTCLPLGVL (PRAME_HUMAN)
  Core: LKAMVQAWP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTXKAXVXAWXFTCLPLGVL

SEQ ID NO: 350201 - protein, 25 aa, Artificial Sequence
  Description of Artificial Sequence: Synthetic peptide
  Seed: DGRHSQTLKAMVQAWPFTCLPLGVL (PRAME_HUMAN)
  Core: KAMVQAWPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLXAMXQXWPXTCLPLGVL

SEQ ID NO: 350202 - protein, 25 aa, Artificial Sequence
  Description of Artificial Sequence: Synthetic peptide
  Seed: DGRHSQTLKAMVQAWPFTCLPLGVL (PRAME_HUMAN)
  Core: MVQAWPFTC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAXVQXWXFTXLPLGVL

SEQ ID NO: 350203 - protein, 25 aa, Artificial Sequence
  Description of Artificial Sequence: Synthetic peptide
  Seed: DGRHSQTLKAMVQAWPFTCLPLGVL (PRAME_HUMAN)
  Core: VQAWPFTCL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DGRHSQTLKAMXQAXPXTCXPLGVL

SEQ ID NO: 350204 - protein, 14 aa, Artificial Sequence
  Description of Artificial Sequence: Synthetic peptide
  Seed: DIHGTLHLERLAYL (PRAME_HUMAN)
  Core: IHGTLHLER
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXHGXLXLEXLAYL

SEQ ID NO: 350205 - protein, 14 aa, Artificial Sequence
  Description of Artificial Sequence: Synthetic peptide
  Seed: DIHGTLHLERLAYL (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYX

SEQ ID NO: 350206 - protein, 15 aa, Artificial Sequence
  Description of Artificial Sequence: Synthetic peptide
  Seed: DIHGTLHLERLAYLH (PRAME_HUMAN)
  Core: IHGTLHLER
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXHGXLXLEXLAYLH

SEQ ID NO: 350207 - protein, 15 aa, Artificial Sequence
  Description of Artificial Sequence: Synthetic peptide
  Seed: DIHGTLHLERLAYLH (PRAME_HUMAN)
  Core: TLHLERLAY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIHGXLHXEXLAXLH

SEQ ID NO: 350208 - protein, 15 aa, Artificial Sequence
  Description of Artificial Sequence: Synthetic peptide
  Seed: DIHGTLHLERLAYLH (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXH

SEQ ID NO: 350209 - protein, 16 aa, Artificial Sequence
  Description of Artificial Sequence: Synthetic peptide
  Seed: DIHGTLHLERLAYLHA (PRAME_HUMAN)
  Core: TLHLERLAY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIHGXLHXEXLAXLHA

SEQ ID NO: 350210 - protein, 16 aa, Artificial Sequence
  Description of Artificial Sequence: Synthetic peptide
  Seed: DIHGTLHLERLAYLHA (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHA

SEQ ID NO: 350211 - protein, 17 aa, Artificial Sequence
  Description of Artificial Sequence: Synthetic peptide
  Seed: DIHGTLHLERLAYLHAR (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHAR

SEQ ID NO: 350212 - protein, 17 aa, Artificial Sequence
  Description of Artificial Sequence: Synthetic peptide
  Seed: DIHGTLHLERLAYLHAR (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXR

SEQ ID NO: 350213 - protein, 18 aa, Artificial Sequence
  Description of Artificial Sequence: Synthetic peptide
  Seed: DIHGTLHLERLAYLHARL (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARL

SEQ ID NO: 350214 - protein, 19 aa, Artificial Sequence
  Description of Artificial Sequence: Synthetic peptide
  Seed: DIHGTLHLERLAYLHARLR (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLR

SEQ ID NO: 350215 - protein, 19 aa, Artificial Sequence
  Description of Artificial Sequence: Synthetic peptide
  Seed: DIHGTLHLERLAYLHARLR (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLR

SEQ ID NO: 350216 - protein, 19 aa, Artificial Sequence
  Description of Artificial Sequence: Synthetic peptide
  Seed: DIHGTLHLERLAYLHARLR (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLR

SEQ ID NO: 350217 - protein, 19 aa, Artificial Sequence
  Description of Artificial Sequence: Synthetic peptide
  Seed: DIHGTLHLERLAYLHARLR (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLX

SEQ ID NO: 350218 - protein, 20 aa, Artificial Sequence
  Description of Artificial Sequence: Synthetic peptide
  Seed: DIHGTLHLERLAYLHARLRE (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLRE

SEQ ID NO: 350219 - protein, 20 aa, Artificial Sequence
  Description of Artificial Sequence: Synthetic peptide
  Seed: DIHGTLHLERLAYLHARLRE (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLRE

SEQ ID NO: 350220 - protein, 20 aa, Artificial Sequence
  Description of Artificial Sequence: Synthetic peptide
  Seed: DIHGTLHLERLAYLHARLRE (PRAME_HUMAN)
  Core: RLAYLHARL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLEXLAXLXARXRE

SEQ ID NO: 350221 - protein, 20 aa, Artificial Sequence
  Description of Artificial Sequence: Synthetic peptide
  Seed: DIHGTLHLERLAYLHARLRE (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXE

SEQ ID NO: 350222 - protein, 21 aa, Artificial Sequence
  Description of Artificial Sequence: Synthetic peptide
  Seed: DIHGTLHLERLAYLHARLREL (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLREL

SEQ ID NO: 350223 - protein, 21 aa, Artificial Sequence
  Description of Artificial Sequence: Synthetic peptide
  Seed: DIHGTLHLERLAYLHARLREL (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLREL

SEQ ID NO: 350224 - protein, 21 aa, Artificial Sequence
  Description of Artificial Sequence: Synthetic peptide
  Seed: DIHGTLHLERLAYLHARLREL (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLREL

SEQ ID NO: 350225 - protein, 21 aa, Artificial Sequence
  Description of Artificial Sequence: Synthetic peptide
  Seed: DIHGTLHLERLAYLHARLREL (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXEL

SEQ ID NO: 350226 - protein, 21 aa, Artificial Sequence
  Description of Artificial Sequence: Synthetic peptide
  Seed: DIHGTLHLERLAYLHARLREL (PRAME_HUMAN)
  Core: YLHARLREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERLAXLHXRXREX

SEQ ID NO: 350227 - protein, 22 aa, Artificial Sequence
  Description of Artificial Sequence: Synthetic peptide
  Seed: DIHGTLHLERLAYLHARLRELL (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLRELL

SEQ ID NO: 350228 - protein, 22 aa, Artificial Sequence
  Description of Artificial Sequence: Synthetic peptide
  Seed: DIHGTLHLERLAYLHARLRELL (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLRELL

SEQ ID NO: 350229 - protein, 22 aa, Artificial Sequence
  Description of Artificial Sequence: Synthetic peptide
  Seed: DIHGTLHLERLAYLHARLRELL (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLRELL

SEQ ID NO: 350230 - protein, 22 aa, Artificial Sequence
  Description of Artificial Sequence: Synthetic peptide
  Seed: DIHGTLHLERLAYLHARLRELL (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXELL

SEQ ID NO: 350231 - protein, 22 aa, Artificial Sequence
  Description of Artificial Sequence: Synthetic peptide
  Seed: DIHGTLHLERLAYLHARLRELL (PRAME_HUMAN)
  Core: YLHARLREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERLAXLHXRXREXL

SEQ ID NO: 350232 - protein, 23 aa, Artificial Sequence
  Description of Artificial Sequence: Synthetic peptide
  Seed: DIHGTLHLERLAYLHARLRELLC (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLRELLC

SEQ ID NO: 350233 - protein, 23 aa, Artificial Sequence
  Description of Artificial Sequence: Synthetic peptide
  Seed: DIHGTLHLERLAYLHARLRELLC (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLRELLC

SEQ ID NO: 350234 - protein, 23 aa, Artificial Sequence
  Description of Artificial Sequence: Synthetic peptide
  Seed: DIHGTLHLERLAYLHARLRELLC (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLRELLC

SEQ ID NO: 350235 - protein, 23 aa, Artificial Sequence
  Description of Artificial Sequence: Synthetic peptide
  Seed: DIHGTLHLERLAYLHARLRELLC (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXELLC

SEQ ID NO: 350236 - protein, 23 aa, Artificial Sequence
  Description of Artificial Sequence: Synthetic peptide
  Seed: DIHGTLHLERLAYLHARLRELLC (PRAME_HUMAN)
  Core: YLHARLREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERLAXLHXRXREXLC

SEQ ID NO: 350237 - protein, 24 aa, Artificial Sequence
  Description of Artificial Sequence: Synthetic peptide
  Seed: DIHGTLHLERLAYLHARLRELLCE (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLRELLCE

SEQ ID NO: 350238 - protein, 24 aa, Artificial Sequence
  Description of Artificial Sequence: Synthetic peptide
  Seed: DIHGTLHLERLAYLHARLRELLCE (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLRELLCE

SEQ ID NO: 350239 - protein, 24 aa, Artificial Sequence
  Description of Artificial Sequence: Synthetic peptide
  Seed: DIHGTLHLERLAYLHARLRELLCE (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLRELLCE

SEQ ID NO: 350240 - protein, 24 aa, Artificial Sequence
  Description of Artificial Sequence: Synthetic peptide
  Seed: DIHGTLHLERLAYLHARLRELLCE (PRAME_HUMAN)
  Core: RLAYLHARL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLEXLAXLXARXRELLCE

SEQ ID NO: 350241 - protein, 24 aa, Artificial Sequence
  Description of Artificial Sequence: Synthetic peptide
  Seed: DIHGTLHLERLAYLHARLRELLCE (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXELLCE

SEQ ID NO: 350242 - protein, 24 aa, Artificial Sequence
  Description of Artificial Sequence: Synthetic peptide
  Seed: DIHGTLHLERLAYLHARLRELLCE (PRAME_HUMAN)
  Core: YLHARLREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERLAXLHXRXREXLCE

SEQ ID NO: 350243 - protein, 25 aa, Artificial Sequence
  Description of Artificial Sequence: Synthetic peptide
  Seed: DIHGTLHLERLAYLHARLRELLCEL (PRAME_HUMAN)
  Core: LHLERLAYL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTXHLXRXAYXHARLRELLCEL

SEQ ID NO: 350244 - protein, 25 aa, Artificial Sequence
  Description of Artificial Sequence: Synthetic peptide
  Seed: DIHGTLHLERLAYLHARLRELLCEL (PRAME_HUMAN)
  Core: LERLAYLHA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHXERXAXLHXRLRELLCEL

SEQ ID NO: 350245 - protein, 25 aa, Artificial Sequence
  Description of Artificial Sequence: Synthetic peptide
  Seed: DIHGTLHLERLAYLHARLRELLCEL (PRAME_HUMAN)
  Core: ERLAYLHAR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLXRLXYXHAXLRELLCEL

SEQ ID NO: 350246 - protein, 25 aa, Artificial Sequence
  Description of Artificial Sequence: Synthetic peptide
  Seed: DIHGTLHLERLAYLHARLRELLCEL (PRAME_HUMAN)
  Core: RLAYLHARL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLEXLAXLXARXRELLCEL

SEQ ID NO: 350247 - protein, 25 aa, Artificial Sequence
  Description of Artificial Sequence: Synthetic peptide
  Seed: DIHGTLHLERLAYLHARLRELLCEL (PRAME_HUMAN)
  Core: LAYLHARLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERXAYXHXRLXELLCEL

SEQ ID NO: 350248 - protein, 25 aa, Artificial Sequence
  Description of Artificial Sequence: Synthetic peptide
  Seed: DIHGTLHLERLAYLHARLRELLCEL (PRAME_HUMAN)
  Core: YLHARLREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DIHGTLHLERLAXLHXRXREXLCEL

SEQ ID NO: 350249 - protein, 13 aa, Artificial Sequence
  Description of Artificial Sequence: Synthetic peptide
  Seed: DIKMILKMVQLDS (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDS

SEQ ID NO: 350250 - protein, 13 aa, Artificial Sequence
  Description of Artificial Sequence: Synthetic peptide
  Seed: DIKMILKMVQLDS (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXS

SEQ ID NO: 350251 - protein, 14 aa, Artificial Sequence
  Description of Artificial Sequence: Synthetic peptide
  Seed: DIKMILKMVQLDSI (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSI

SEQ ID NO: 350252 - protein, 14 aa, Artificial Sequence
  Description of Artificial Sequence: Synthetic peptide
  Seed: DIKMILKMVQLDSI (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSI

SEQ ID NO: 350253 - protein, 14 aa, Artificial Sequence
  Description of Artificial Sequence: Synthetic peptide
  Seed: DIKMILKMVQLDSI (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSX

SEQ ID NO: 350254 - protein, 15 aa, Artificial Sequence
  Description of Artificial Sequence: Synthetic peptide
  Seed: DIKMILKMVQLDSIE (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIE

SEQ ID NO: 350255 - protein, 15 aa, Artificial Sequence
  Description of Artificial Sequence: Synthetic peptide
  Seed: DIKMILKMVQLDSIE (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIE

SEQ ID NO: 350256 - protein, 15 aa, Artificial Sequence
  Description of Artificial Sequence: Synthetic peptide
  Seed: DIKMILKMVQLDSIE (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIE

SEQ ID NO: 350257 - protein, 15 aa, Artificial Sequence
  Description of Artificial Sequence: Synthetic peptide
  Seed: DIKMILKMVQLDSIE (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXE

SEQ ID NO: 350258 - protein, 16 aa, Artificial Sequence
  Description of Artificial Sequence: Synthetic peptide
  Seed: DIKMILKMVQLDSIED (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIED

SEQ ID NO: 350259 - protein, 16 aa, Artificial Sequence
  Description of Artificial Sequence: Synthetic peptide
  Seed: DIKMILKMVQLDSIED (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIED

SEQ ID NO: 350260 - protein, 16 aa, Artificial Sequence
  Description of Artificial Sequence: Synthetic peptide
  Seed: DIKMILKMVQLDSIED (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIED

SEQ ID NO: 350261 - protein, 16 aa, Artificial Sequence
  Description of Artificial Sequence: Synthetic peptide
  Seed: DIKMILKMVQLDSIED (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXED

SEQ ID NO: 350262 - protein, 16 aa, Artificial Sequence
  Description of Artificial Sequence: Synthetic peptide
  Seed: DIKMILKMVQLDSIED (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEX

SEQ ID NO: 350263 - protein, 17 aa, Artificial Sequence
  Description of Artificial Sequence: Synthetic peptide
  Seed: DIKMILKMVQLDSIEDL (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDL

SEQ ID NO: 350264 - protein, 17 aa, Artificial Sequence
  Description of Artificial Sequence: Synthetic peptide
  Seed: DIKMILKMVQLDSIEDL (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDL

SEQ ID NO: 350265 - protein, 17 aa, Artificial Sequence
  Description of Artificial Sequence: Synthetic peptide
  Seed: DIKMILKMVQLDSIEDL (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDL

SEQ ID NO: 350266 - protein, 17 aa, Artificial Sequence
  Description of Artificial Sequence: Synthetic peptide
  Seed: DIKMILKMVQLDSIEDL (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDL

SEQ ID NO: 350267 - protein, 17 aa, Artificial Sequence
  Description of Artificial Sequence: Synthetic peptide
  Seed: DIKMILKMVQLDSIEDL (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXL

SEQ ID NO: 350268 - protein, 18 aa, Artificial Sequence
  Description of Artificial Sequence: Synthetic peptide
  Seed: DIKMILKMVQLDSIEDLE (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLE

SEQ ID NO: 350269 - protein, 18 aa, Artificial Sequence
  Description of Artificial Sequence: Synthetic peptide
  Seed: DIKMILKMVQLDSIEDLE (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLE

SEQ ID NO: 350270 - protein, 18 aa, Artificial Sequence
  Description of Artificial Sequence: Synthetic peptide
  Seed: DIKMILKMVQLDSIEDLE (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLE

SEQ ID NO: 350271 - protein, 18 aa, Artificial Sequence
  Description of Artificial Sequence: Synthetic peptide
  Seed: DIKMILKMVQLDSIEDLE (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXE

SEQ ID NO: 350272 - protein, 19 aa, Artificial Sequence
  Description of Artificial Sequence: Synthetic peptide
  Seed: DIKMILKMVQLDSIEDLEV (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEV

SEQ ID NO: 350273 - protein, 19 aa, Artificial Sequence
  Description of Artificial Sequence: Synthetic peptide
  Seed: DIKMILKMVQLDSIEDLEV (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEV

SEQ ID NO: 350274 - protein, 19 aa, Artificial Sequence
  Description of Artificial Sequence: Synthetic peptide
  Seed: DIKMILKMVQLDSIEDLEV (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEV

SEQ ID NO: 350275 - protein, 19 aa, Artificial Sequence
  Description of Artificial Sequence: Synthetic peptide
  Seed: DIKMILKMVQLDSIEDLEV (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEV

SEQ ID NO: 350276 - protein, 19 aa, Artificial Sequence
  Description of Artificial Sequence: Synthetic peptide
  Seed: DIKMILKMVQLDSIEDLEV (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEV

SEQ ID NO: 350277 - protein, 19 aa, Artificial Sequence
  Description of Artificial Sequence: Synthetic peptide
  Seed: DIKMILKMVQLDSIEDLEV (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEX

SEQ ID NO: 350278 - protein, 20 aa, Artificial Sequence
  Description of Artificial Sequence: Synthetic peptide
  Seed: DIKMILKMVQLDSIEDLEVT (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVT

SEQ ID NO: 350279 - protein, 20 aa, Artificial Sequence
  Description of Artificial Sequence: Synthetic peptide
  Seed: DIKMILKMVQLDSIEDLEVT (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVT

SEQ ID NO: 350280 - protein, 20 aa, Artificial Sequence
  Description of Artificial Sequence: Synthetic peptide
  Seed: DIKMILKMVQLDSIEDLEVT (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVT

SEQ ID NO: 350281 - protein, 20 aa, Artificial Sequence
  Description of Artificial Sequence: Synthetic peptide
  Seed: DIKMILKMVQLDSIEDLEVT (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVT

SEQ ID NO: 350282 - protein, 20 aa, Artificial Sequence
  Description of Artificial Sequence: Synthetic peptide
  Seed: DIKMILKMVQLDSIEDLEVT (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVT

SEQ ID NO: 350283 - protein, 20 aa, Artificial Sequence
  Description of Artificial Sequence: Synthetic peptide
  Seed: DIKMILKMVQLDSIEDLEVT (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXT

SEQ ID NO: 350284 - protein, 21 aa, Artificial Sequence
  Description of Artificial Sequence: Synthetic peptide
  Seed: DIKMILKMVQLDSIEDLEVTC (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDLEVTC

SEQ ID NO: 350285 - protein, 21 aa, Artificial Sequence
  Description of Artificial Sequence: Synthetic peptide
  Seed: DIKMILKMVQLDSIEDLEVTC (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVTC

SEQ ID NO: 350286 - protein, 21 aa, Artificial Sequence
  Description of Artificial Sequence: Synthetic peptide
  Seed: DIKMILKMVQLDSIEDLEVTC (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVTC

SEQ ID NO: 350287 - protein, 21 aa, Artificial Sequence
  Description of Artificial Sequence: Synthetic peptide
  Seed: DIKMILKMVQLDSIEDLEVTC (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVTC

SEQ ID NO: 350288 - protein, 21 aa, Artificial Sequence
  Description of Artificial Sequence: Synthetic peptide
  Seed: DIKMILKMVQLDSIEDLEVTC (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVTC

SEQ ID NO: 350289 - protein, 21 aa, Artificial Sequence
  Description of Artificial Sequence: Synthetic peptide
  Seed: DIKMILKMVQLDSIEDLEVTC (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVTC

SEQ ID NO: 350290 - protein, 21 aa, Artificial Sequence
  Description of Artificial Sequence: Synthetic peptide
  Seed: DIKMILKMVQLDSIEDLEVTC (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXTC

SEQ ID NO: 350291 - protein, 22 aa, Artificial Sequence
  Description of Artificial Sequence: Synthetic peptide
  Seed: DIKMILKMVQLDSIEDLEVTCT (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDLEVTCT

SEQ ID NO: 350292 - protein, 22 aa, Artificial Sequence
  Description of Artificial Sequence: Synthetic peptide
  Seed: DIKMILKMVQLDSIEDLEVTCT (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVTCT

SEQ ID NO: 350293 - protein, 22 aa, Artificial Sequence
  Description of Artificial Sequence: Synthetic peptide
  Seed: DIKMILKMVQLDSIEDLEVTCT (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVTCT

SEQ ID NO: 350294 - protein, 22 aa, Artificial Sequence
  Description of Artificial Sequence: Synthetic peptide
  Seed: DIKMILKMVQLDSIEDLEVTCT (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVTCT

SEQ ID NO: 350295 - protein, 22 aa, Artificial Sequence
  Description of Artificial Sequence: Synthetic peptide
  Seed: DIKMILKMVQLDSIEDLEVTCT (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVTCT

SEQ ID NO: 350296 - protein, 22 aa, Artificial Sequence
  Description of Artificial Sequence: Synthetic peptide
  Seed: DIKMILKMVQLDSIEDLEVTCT (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVTCT

SEQ ID NO: 350297 - protein, 22 aa, Artificial Sequence
  Description of Artificial Sequence: Synthetic peptide
  Seed: DIKMILKMVQLDSIEDLEVTCT (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXTCT

SEQ ID NO: 350298 - protein, 23 aa, Artificial Sequence
  Description of Artificial Sequence: Synthetic peptide
  Seed: DIKMILKMVQLDSIEDLEVTCTW (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDLEVTCTW

SEQ ID NO: 350299 - protein, 23 aa, Artificial Sequence
  Description of Artificial Sequence: Synthetic peptide
  Seed: DIKMILKMVQLDSIEDLEVTCTW (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVTCTW

SEQ ID NO: 350300 - protein, 23 aa, Artificial Sequence
  Description of Artificial Sequence: Synthetic peptide
  Seed: DIKMILKMVQLDSIEDLEVTCTW (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVTCTW

SEQ ID NO: 350301 - protein, 23 aa, Artificial Sequence
  Description of Artificial Sequence: Synthetic peptide
  Seed: DIKMILKMVQLDSIEDLEVTCTW (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVTCTW

SEQ ID NO: 350302 - protein, 23 aa, Artificial Sequence
  Description of Artificial Sequence: Synthetic peptide
  Seed: DIKMILKMVQLDSIEDLEVTCTW (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVTCTW

SEQ ID NO: 350303 - protein, 23 aa, Artificial Sequence
  Description of Artificial Sequence: Synthetic peptide
  Seed: DIKMILKMVQLDSIEDLEVTCTW (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVTCTW

SEQ ID NO: 350304 - protein, 23 aa, Artificial Sequence
  Description of Artificial Sequence: Synthetic peptide
  Seed: DIKMILKMVQLDSIEDLEVTCTW (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXTCTW

SEQ ID NO: 350305 - protein, 24 aa, Artificial Sequence
  Description of Artificial Sequence: Synthetic peptide
  Seed: DIKMILKMVQLDSIEDLEVTCTWK (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDLEVTCTWK

SEQ ID NO: 350306 - protein, 24 aa, Artificial Sequence
  Description of Artificial Sequence: Synthetic peptide
  Seed: DIKMILKMVQLDSIEDLEVTCTWK (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVTCTWK

SEQ ID NO: 350307 - protein, 24 aa, Artificial Sequence
  Description of Artificial Sequence: Synthetic peptide
  Seed: DIKMILKMVQLDSIEDLEVTCTWK (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVTCTWK

SEQ ID NO: 350308 - protein, 24 aa, Artificial Sequence
  Description of Artificial Sequence: Synthetic peptide
  Seed: DIKMILKMVQLDSIEDLEVTCTWK (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVTCTWK

SEQ ID NO: 350309 - protein, 24 aa, Artificial Sequence
  Description of Artificial Sequence: Synthetic peptide
  Seed: DIKMILKMVQLDSIEDLEVTCTWK (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVTCTWK

SEQ ID NO: 350310 - protein, 24 aa, Artificial Sequence
  Description of Artificial Sequence: Synthetic peptide
  Seed: DIKMILKMVQLDSIEDLEVTCTWK (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVTCTWK

SEQ ID NO: 350311 - protein, 24 aa, Artificial Sequence
  Description of Artificial Sequence: Synthetic peptide
  Seed: DIKMILKMVQLDSIEDLEVTCTWK (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXTCTWK

SEQ ID NO: 350312 - protein, 25 aa, Artificial Sequence
  Description of Artificial Sequence: Synthetic peptide
  Seed: DIKMILKMVQLDSIEDLEVTCTWKL (PRAME_HUMAN)
  Core: IKMILKMVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXKMXLXMVXLDSIEDLEVTCTWKL

SEQ ID NO: 350313 - protein, 25 aa, Artificial Sequence
  Description of Artificial Sequence: Synthetic peptide
  Seed: DIKMILKMVQLDSIEDLEVTCTWKL (PRAME_HUMAN)
  Core: MILKMVQLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DIKXILXMXQLXSIEDLEVTCTWKL

SEQ ID NO: 350314 - protein, 25 aa, Artificial Sequence
  Description of Artificial Sequence: Synthetic peptide
  Seed: DIKMILKMVQLDSIEDLEVTCTWKL (PRAME_HUMAN)
  Core: ILKMVQLDS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DIKMXLKXVXLDXIEDLEVTCTWKL

SEQ ID NO: 350315 - protein, 25 aa, Artificial Sequence
  Description of Artificial Sequence: Synthetic peptide
  Seed: DIKMILKMVQLDSIEDLEVTCTWKL (PRAME_HUMAN)
  Core: LKMVQLDSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DIKMIXKMXQXDSXEDLEVTCTWKL

SEQ ID NO: 350316 - protein, 25 aa, Artificial Sequence
  Description of Artificial Sequence: Synthetic peptide
  Seed: DIKMILKMVQLDSIEDLEVTCTWKL (PRAME_HUMAN)
  Core: MVQLDSIED
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKXVQXDXIEXLEVTCTWKL

SEQ ID NO: 350317 - protein, 25 aa, Artificial Sequence
  Description of Artificial Sequence: Synthetic peptide
  Seed: DIKMILKMVQLDSIEDLEVTCTWKL (PRAME_HUMAN)
  Core: VQLDSIEDL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMXQLXSXEDXEVTCTWKL

SEQ ID NO: 350318 - protein, 25 aa, Artificial Sequence
  Description of Artificial Sequence: Synthetic peptide
  Seed: DIKMILKMVQLDSIEDLEVTCTWKL (PRAME_HUMAN)
  Core: LDSIEDLEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DIKMILKMVQXDSXEXLEXTCTWKL

SEQ ID NO: 350319 - protein, 14 aa, Artificial Sequence
  Description of Artificial Sequence: Synthetic peptide
  Seed: DLEVTCTWKLPTLA (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXA

SEQ ID NO: 350320 - protein, 15 aa, Artificial Sequence
  Description of Artificial Sequence: Synthetic peptide
  Seed: DLEVTCTWKLPTLAK (PRAME_HUMAN)
  Core: LEVTCTWKL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXEVXCXWKXPTLAK

SEQ ID NO: 350321 - protein, 15 aa, Artificial Sequence
  Description of Artificial Sequence: Synthetic peptide
  Seed: DLEVTCTWKLPTLAK (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAK

SEQ ID NO: 350322 - protein, 15 aa, Artificial Sequence
  Description of Artificial Sequence: Synthetic peptide
  Seed: DLEVTCTWKLPTLAK (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAK

SEQ ID NO: 350323 - protein, 16 aa, Artificial Sequence
  Description of Artificial Sequence: Synthetic peptide
  Seed: DLEVTCTWKLPTLAKF (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKF

SEQ ID NO: 350324 - protein, 16 aa, Artificial Sequence
  Description of Artificial Sequence: Synthetic peptide
  Seed: DLEVTCTWKLPTLAKF (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAKF

SEQ ID NO: 350325 - protein, 16 aa, Artificial Sequence
  Description of Artificial Sequence: Synthetic peptide
  Seed: DLEVTCTWKLPTLAKF (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKF

SEQ ID NO: 350326 - protein, 16 aa, Artificial Sequence
  Description of Artificial Sequence: Synthetic peptide
  Seed: DLEVTCTWKLPTLAKF (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKX

SEQ ID NO: 350327 - protein, 17 aa, Artificial Sequence
  Description of Artificial Sequence: Synthetic peptide
  Seed: DLEVTCTWKLPTLAKFS (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFS

SEQ ID NO: 350328 - protein, 17 aa, Artificial Sequence
  Description of Artificial Sequence: Synthetic peptide
  Seed: DLEVTCTWKLPTLAKFS (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAKFS

SEQ ID NO: 350329 - protein, 17 aa, Artificial Sequence
  Description of Artificial Sequence: Synthetic peptide
  Seed: DLEVTCTWKLPTLAKFS (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFS

SEQ ID NO: 350330 - protein, 17 aa, Artificial Sequence
  Description of Artificial Sequence: Synthetic peptide
  Seed: DLEVTCTWKLPTLAKFS (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXS

SEQ ID NO: 350331 - protein, 18 aa, Artificial Sequence
  Description of Artificial Sequence: Synthetic peptide
  Seed: DLEVTCTWKLPTLAKFSP (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAKFSP

SEQ ID NO: 350332 - protein, 19 aa, Artificial Sequence
  Description of Artificial Sequence: Synthetic peptide
  Seed: DLEVTCTWKLPTLAKFSPY (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPY

SEQ ID NO: 350333 - protein, 19 aa, Artificial Sequence
  Description of Artificial Sequence: Synthetic peptide
  Seed: DLEVTCTWKLPTLAKFSPY (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAKFSPY

SEQ ID NO: 350334 - protein, 19 aa, Artificial Sequence
  Description of Artificial Sequence: Synthetic peptide
  Seed: DLEVTCTWKLPTLAKFSPY (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPY

SEQ ID NO: 350335 - protein, 20 aa, Artificial Sequence
  Description of Artificial Sequence: Synthetic peptide
  Seed: DLEVTCTWKLPTLAKFSPYL (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPYL

SEQ ID NO: 350336 - protein, 20 aa, Artificial Sequence
  Description of Artificial Sequence: Synthetic peptide
  Seed: DLEVTCTWKLPTLAKFSPYL (PRAME_HUMAN)
  Core: TCTWKLPTL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLEVXCTXKXPTXAKFSPYL

SEQ ID NO: 350337 - protein, 20 aa, Artificial Sequence
  Description of Artificial Sequence: Synthetic peptide
  Seed: DLEVTCTWKLPTLAKFSPYL (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFSPYL

SEQ ID NO: 350338 - protein, 20 aa, Artificial Sequence
  Description of Artificial Sequence: Synthetic peptide
  Seed: DLEVTCTWKLPTLAKFSPYL (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYL

SEQ ID NO: 350339 - protein, 20 aa, Artificial Sequence
  Description of Artificial Sequence: Synthetic peptide
  Seed: DLEVTCTWKLPTLAKFSPYL (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYL

SEQ ID NO: 350340 - protein, 21 aa, Artificial Sequence
  Description of Artificial Sequence: Synthetic peptide
  Seed: DLEVTCTWKLPTLAKFSPYLG (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPYLG

SEQ ID NO: 350341 - protein, 21 aa, Artificial Sequence
  Description of Artificial Sequence: Synthetic peptide
  Seed: DLEVTCTWKLPTLAKFSPYLG (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFSPYLG

SEQ ID NO: 350342 - protein, 21 aa, Artificial Sequence
  Description of Artificial Sequence: Synthetic peptide
  Seed: DLEVTCTWKLPTLAKFSPYLG (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYLG

SEQ ID NO: 350343 - protein, 21 aa, Artificial Sequence
  Description of Artificial Sequence: Synthetic peptide
  Seed: DLEVTCTWKLPTLAKFSPYLG (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYLG

SEQ ID NO: 350344 - protein, 21 aa, Artificial Sequence
  Description of Artificial Sequence: Synthetic peptide
  Seed: DLEVTCTWKLPTLAKFSPYLG (PRAME_HUMAN)
  Core: PTLAKFSPY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLXTLXKXSPXLG

SEQ ID NO: 350345 - protein, 21 aa, Artificial Sequence
  Description of Artificial Sequence: Synthetic peptide
  Seed: DLEVTCTWKLPTLAKFSPYLG (PRAME_HUMAN)
  Core: LAKFSPYLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTXAKXSXYLX

SEQ ID NO: 350346 - protein, 22 aa, Artificial Sequence
  Description of Artificial Sequence: Synthetic peptide
  Seed: DLEVTCTWKLPTLAKFSPYLGQ (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPYLGQ

SEQ ID NO: 350347 - protein, 22 aa, Artificial Sequence
  Description of Artificial Sequence: Synthetic peptide
  Seed: DLEVTCTWKLPTLAKFSPYLGQ (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFSPYLGQ

SEQ ID NO: 350348 - protein, 22 aa, Artificial Sequence
  Description of Artificial Sequence: Synthetic peptide
  Seed: DLEVTCTWKLPTLAKFSPYLGQ (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYLGQ

SEQ ID NO: 350349 - protein, 22 aa, Artificial Sequence
  Description of Artificial Sequence: Synthetic peptide
  Seed: DLEVTCTWKLPTLAKFSPYLGQ (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYLGQ

SEQ ID NO: 350350 - protein, 22 aa, Artificial Sequence
  Description of Artificial Sequence: Synthetic peptide
  Seed: DLEVTCTWKLPTLAKFSPYLGQ (PRAME_HUMAN)
  Core: PTLAKFSPY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLXTLXKXSPXLGQ

SEQ ID NO: 350351 - protein, 22 aa, Artificial Sequence
  Description of Artificial Sequence: Synthetic peptide
  Seed: DLEVTCTWKLPTLAKFSPYLGQ (PRAME_HUMAN)
  Core: LAKFSPYLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTXAKXSXYLXQ

SEQ ID NO: 350352 - protein, 23 aa, Artificial Sequence
  Description of Artificial Sequence: Synthetic peptide
  Seed: DLEVTCTWKLPTLAKFSPYLGQM (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPYLGQM

SEQ ID NO: 350353 - protein, 23 aa, Artificial Sequence
  Description of Artificial Sequence: Synthetic peptide
  Seed: DLEVTCTWKLPTLAKFSPYLGQM (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFSPYLGQM

SEQ ID NO: 350354 - protein, 23 aa, Artificial Sequence
  Description of Artificial Sequence: Synthetic peptide
  Seed: DLEVTCTWKLPTLAKFSPYLGQM (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYLGQM

SEQ ID NO: 350355 - protein, 23 aa, Artificial Sequence
  Description of Artificial Sequence: Synthetic peptide
  Seed: DLEVTCTWKLPTLAKFSPYLGQM (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYLGQM

SEQ ID NO: 350356 - protein, 23 aa, Artificial Sequence
  Description of Artificial Sequence: Synthetic peptide
  Seed: DLEVTCTWKLPTLAKFSPYLGQM (PRAME_HUMAN)
  Core: PTLAKFSPY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLXTLXKXSPXLGQM

SEQ ID NO: 350357 - protein, 23 aa, Artificial Sequence
  Description of Artificial Sequence: Synthetic peptide
  Seed: DLEVTCTWKLPTLAKFSPYLGQM (PRAME_HUMAN)
  Core: LAKFSPYLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTXAKXSXYLXQM

SEQ ID NO: 350358 - protein, 24 aa, Artificial Sequence
  Description of Artificial Sequence: Synthetic peptide
  Seed: DLEVTCTWKLPTLAKFSPYLGQMI (PRAME_HUMAN)
  Core: VTCTWKLPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLEXTCXWXLPXLAKFSPYLGQMI

SEQ ID NO: 350359 - protein, 24 aa, Artificial Sequence
  Description of Artificial Sequence: Synthetic peptide
  Seed: DLEVTCTWKLPTLAKFSPYLGQMI (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYLGQMI

SEQ ID NO: 350360 - protein, 24 aa, Artificial Sequence
  Description of Artificial Sequence: Synthetic peptide
  Seed: DLEVTCTWKLPTLAKFSPYLGQMI (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYLGQMI

SEQ ID NO: 350361 - protein, 24 aa, Artificial Sequence
  Description of Artificial Sequence: Synthetic peptide
  Seed: DLEVTCTWKLPTLAKFSPYLGQMI (PRAME_HUMAN)
  Core: PTLAKFSPY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLXTLXKXSPXLGQMI

SEQ ID NO: 350362 - protein, 24 aa, Artificial Sequence
  Description of Artificial Sequence: Synthetic peptide
  Seed: DLEVTCTWKLPTLAKFSPYLGQMI (PRAME_HUMAN)
  Core: LAKFSPYLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTXAKXSXYLXQMI

SEQ ID NO: 350363 - protein, 24 aa, Artificial Sequence
  Description of Artificial Sequence: Synthetic peptide
  Seed: DLEVTCTWKLPTLAKFSPYLGQMI (PRAME_HUMAN)
  Core: AKFSPYLGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTLXKFXPXLGXMI

SEQ ID NO: 350364 - protein, 24 aa, Artificial Sequence
  Description of Artificial Sequence: Synthetic peptide
  Seed: DLEVTCTWKLPTLAKFSPYLGQMI (PRAME_HUMAN)
  Core: FSPYLGQMI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTLAKXSPXLXQMX

SEQ ID NO: 350365 - protein, 25 aa, Artificial Sequence
  Description of Artificial Sequence: Synthetic peptide
  Seed: DLEVTCTWKLPTLAKFSPYLGQMIN (PRAME_HUMAN)
  Core: CTWKLPTLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTXTWXLXTLXKFSPYLGQMIN

SEQ ID NO: 350366 - protein, 25 aa, Artificial Sequence
  Description of Artificial Sequence: Synthetic peptide
  Seed: DLEVTCTWKLPTLAKFSPYLGQMIN (PRAME_HUMAN)
  Core: WKLPTLAKF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTXKLXTXAKXSPYLGQMIN

SEQ ID NO: 350367 - protein, 25 aa, Artificial Sequence
  Description of Artificial Sequence: Synthetic peptide
  Seed: DLEVTCTWKLPTLAKFSPYLGQMIN (PRAME_HUMAN)
  Core: KLPTLAKFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWXLPXLXKFXPYLGQMIN

SEQ ID NO: 350368 - protein, 25 aa, Artificial Sequence
  Description of Artificial Sequence: Synthetic peptide
  Seed: DLEVTCTWKLPTLAKFSPYLGQMIN (PRAME_HUMAN)
  Core: PTLAKFSPY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLXTLXKXSPXLGQMIN

SEQ ID NO: 350369 - protein, 25 aa, Artificial Sequence
  Description of Artificial Sequence: Synthetic peptide
  Seed: DLEVTCTWKLPTLAKFSPYLGQMIN (PRAME_HUMAN)
  Core: LAKFSPYLG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTXAKXSXYLXQMIN

SEQ ID NO: 350370 - protein, 25 aa, Artificial Sequence
  Description of Artificial Sequence: Synthetic peptide
  Seed: DLEVTCTWKLPTLAKFSPYLGQMIN (PRAME_HUMAN)
  Core: AKFSPYLGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTLXKFXPXLGXMIN

SEQ ID NO: 350371 - protein, 25 aa, Artificial Sequence
  Description of Artificial Sequence: Synthetic peptide
  Seed: DLEVTCTWKLPTLAKFSPYLGQMIN (PRAME_HUMAN)
  Core: FSPYLGQMI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DLEVTCTWKLPTLAKXSPXLXQMXN

SEQ ID NO: 350372 - protein, 15 aa, Artificial Sequence
  Description of Artificial Sequence: Synthetic peptide
  Seed: DLFLKEGACDELFSY (PRAME_HUMAN)
  Core: FLKEGACDE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DLXLKXGXCDXLFSY

SEQ ID NO: 350373 - protein, 15 aa, Artificial Sequence
  Description of Artificial Sequence: Synthetic peptide
  Seed: DLFLKEGACDELFSY (PRAME_HUMAN)
  Core: LKEGACDEL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLFXKEXAXDEXFSY

SEQ ID NO: 350374 - protein, 15 aa, Artificial Sequence
  Description of Artificial Sequence: Synthetic peptide
  Seed: DLFLKEGACDELFSY (PRAME_HUMAN)
  Core: KEGACDELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLFLXEGXCXELXSY

SEQ ID NO: 350375 - protein, 16 aa, Artificial Sequence
  Description of Artificial Sequence: Synthetic peptide
  Seed: DLFLKEGACDELFSYL (PRAME_HUMAN)
  Core: FLKEGACDE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DLXLKXGXCDXLFSYL

SEQ ID NO: 350376 - protein, 16 aa, Artificial Sequence
  Description of Artificial Sequence: Synthetic peptide
  Seed: DLFLKEGACDELFSYL (PRAME_HUMAN)
  Core: KEGACDELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLFLXEGXCXELXSYL

SEQ ID NO: 350377 - protein, 17 aa, Artificial Sequence
  Description of Artificial Sequence: Synthetic peptide
  Seed: DLFLKEGACDELFSYLI (PRAME_HUMAN)
  Core: LFLKEGACD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXFLXEXACXELFSYLI

SEQ ID NO: 350378 - protein, 17 aa, Artificial Sequence
  Description of Artificial Sequence: Synthetic peptide
  Seed: DLFLKEGACDELFSYLI (PRAME_HUMAN)
  Core: FLKEGACDE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DLXLKXGXCDXLFSYLI

SEQ ID NO: 350379 - protein, 17 aa, Artificial Sequence
  Description of Artificial Sequence: Synthetic peptide
  Seed: DLFLKEGACDELFSYLI (PRAME_HUMAN)
  Core: LKEGACDEL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLFXKEXAXDEXFSYLI

SEQ ID NO: 350380 - protein, 17 aa, Artificial Sequence
  Description of Artificial Sequence: Synthetic peptide
  Seed: DLFLKEGACDELFSYLI (PRAME_HUMAN)
  Core: KEGACDELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLFLXEGXCXELXSYLI

SEQ ID NO: 350381 - protein, 19 aa, Artificial Sequence
  Description of Artificial Sequence: Synthetic peptide
  Seed: DLFLKEGACDELFSYLIEK (PRAME_HUMAN)
  Core: LKEGACDEL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLFXKEXAXDEXFSYLIEK

SEQ ID NO: 350382 - protein, 19 aa, Artificial Sequence
  Description of Artificial Sequence: Synthetic peptide
  Seed: DLFLKEGACDELFSYLIEK (PRAME_HUMAN)
  Core: KEGACDELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLFLXEGXCXELXSYLIEK

SEQ ID NO: 350383 - protein, 19 aa, Artificial Sequence
  Description of Artificial Sequence: Synthetic peptide
  Seed: DLFLKEGACDELFSYLIEK (PRAME_HUMAN)
  Core: ACDELFSYL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGXCDXLXSYXIEK

SEQ ID NO: 350384 - protein, 19 aa, Artificial Sequence
  Description of Artificial Sequence: Synthetic peptide
  Seed: DLFLKEGACDELFSYLIEK (PRAME_HUMAN)
  Core: CDELFSYLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGAXDEXFXYLXEK

SEQ ID NO: 350385 - protein, 20 aa, Artificial Sequence
  Description of Artificial Sequence: Synthetic peptide
  Seed: DLFLKEGACDELFSYLIEKV (PRAME_HUMAN)
  Core: LKEGACDEL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLFXKEXAXDEXFSYLIEKV

SEQ ID NO: 350386 - protein, 20 aa, Artificial Sequence
  Description of Artificial Sequence: Synthetic peptide
  Seed: DLFLKEGACDELFSYLIEKV (PRAME_HUMAN)
  Core: KEGACDELF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLFLXEGXCXELXSYLIEKV

SEQ ID NO: 350387 - protein, 20 aa, Artificial Sequence
  Description of Artificial Sequence: Synthetic peptide
  Seed: DLFLKEGACDELFSYLIEKV (PRAME_HUMAN)
  Core: ACDELFSYL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGXCDXLXSYXIEKV

SEQ ID NO: 350388 - protein, 20 aa, Artificial Sequence
  Description of Artificial Sequence: Synthetic peptide
  Seed: DLFLKEGACDELFSYLIEKV (PRAME_HUMAN)
  Core: CDELFSYLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGAXDEXFXYLXEKV

SEQ ID NO: 350389 - protein, 20 aa, Artificial Sequence
  Description of Artificial Sequence: Synthetic peptide
  Seed: DLFLKEGACDELFSYLIEKV (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKX

SEQ ID NO: 350390 - protein, 21 aa, Artificial Sequence
  Description of Artificial Sequence: Synthetic peptide
  Seed: DLFLKEGACDELFSYLIEKVK (PRAME_HUMAN)
  Core: EGACDELFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKXGAXDXLFXYLIEKVK

SEQ ID NO: 350391 - protein, 21 aa, Artificial Sequence
  Description of Artificial Sequence: Synthetic peptide
  Seed: DLFLKEGACDELFSYLIEKVK (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKXK

SEQ ID NO: 350392 - protein, 22 aa, Artificial Sequence
  Description of Artificial Sequence: Synthetic peptide
  Seed: DLFLKEGACDELFSYLIEKVKR (PRAME_HUMAN)
  Core: EGACDELFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKXGAXDXLFXYLIEKVKR

SEQ ID NO: 350393 - protein, 22 aa, Artificial Sequence
  Description of Artificial Sequence: Synthetic peptide
  Seed: DLFLKEGACDELFSYLIEKVKR (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKXKR

SEQ ID NO: 350394 - protein, 22 aa, Artificial Sequence
  Description of Artificial Sequence: Synthetic peptide
  Seed: DLFLKEGACDELFSYLIEKVKR (PRAME_HUMAN)
  Core: FSYLIEKVK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDELXSYXIXKVXR

SEQ ID NO: 350395 - protein, 23 aa, Artificial Sequence
  Description of Artificial Sequence: Synthetic peptide
  Seed: DLFLKEGACDELFSYLIEKVKRK (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKXKRK

SEQ ID NO: 350396 - protein, 23 aa, Artificial Sequence
  Description of Artificial Sequence: Synthetic peptide
  Seed: DLFLKEGACDELFSYLIEKVKRK (PRAME_HUMAN)
  Core: FSYLIEKVK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDELXSYXIXKVXRK

SEQ ID NO: 350397 - protein, 24 aa, Artificial Sequence
  Description of Artificial Sequence: Synthetic peptide
  Seed: DLFLKEGACDELFSYLIEKVKRKK (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKXKRKK

SEQ ID NO: 350398 - protein, 24 aa, Artificial Sequence
  Description of Artificial Sequence: Synthetic peptide
  Seed: DLFLKEGACDELFSYLIEKVKRKK (PRAME_HUMAN)
  Core: FSYLIEKVK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDELXSYXIXKVXRKK

SEQ ID NO: 350399 - protein, 25 aa, Artificial Sequence
  Description of Artificial Sequence: Synthetic peptide
  Seed: DLFLKEGACDELFSYLIEKVKRKKN (PRAME_HUMAN)
  Core: LFSYLIEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDEXFSXLXEKXKRKKN

SEQ ID NO: 350400 - protein, 25 aa, Artificial Sequence
  Description of Artificial Sequence: Synthetic peptide
  Seed: DLFLKEGACDELFSYLIEKVKRKKN (PRAME_HUMAN)
  Core: FSYLIEKVK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDELXSYXIXKVXRKKN

SEQ ID NO: 350401 - protein, 25 aa, Artificial Sequence
  Description of Artificial Sequence: Synthetic peptide
  Seed: DLFLKEGACDELFSYLIEKVKRKKN (PRAME_HUMAN)
  Core: LIEKVKRKK
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DLFLKEGACDELFSYXIEXVXRKXN

SEQ ID NO: 350402 - protein, 14 aa, Artificial Sequence
  Description of Artificial Sequence: Synthetic peptide
  Seed: DLRKNSHQDFWTVW (PRAME_HUMAN)
  Core: LRKNSHQDF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRKXSXQDXWTVW

SEQ ID NO: 350403 - protein, 15 aa, Artificial Sequence
  Description of Artificial Sequence: Synthetic peptide
  Seed: DLRKNSHQDFWTVWS (PRAME_HUMAN)
  Core: LRKNSHQDF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRKXSXQDXWTVWS

SEQ ID NO: 350404 - protein, 16 aa, Artificial Sequence
  Description of Artificial Sequence: Synthetic peptide
  Seed: DLRKNSHQDFWTVWSG (PRAME_HUMAN)
  Core: LRKNSHQDF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRKXSXQDXWTVWSG

SEQ ID NO: 350405 - protein, 16 aa, Artificial Sequence
  Description of Artificial Sequence: Synthetic peptide
  Seed: DLRKNSHQDFWTVWSG (PRAME_HUMAN)
  Core: KNSHQDFWT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DLRXNSXQXFWXVWSG

SEQ ID NO: 350406 - protein, 19 aa, Artificial Sequence
  Description of Artificial Sequence: Synthetic peptide
  Seed: DLRKNSHQDFWTVWSGNRA (PRAME_HUMAN)
  Core: HQDFWTVWS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSXQDXWXVWXGNRA

SEQ ID NO: 350407 - protein, 19 aa, Artificial Sequence
  Description of Artificial Sequence: Synthetic peptide
  Seed: DLRKNSHQDFWTVWSGNRA (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRA

SEQ ID NO: 350408 - protein, 20 aa, Artificial Sequence
  Description of Artificial Sequence: Synthetic peptide
  Seed: DLRKNSHQDFWTVWSGNRAS (PRAME_HUMAN)
  Core: LRKNSHQDF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXRKXSXQDXWTVWSGNRAS

SEQ ID NO: 350409 - protein, 20 aa, Artificial Sequence
  Description of Artificial Sequence: Synthetic peptide
  Seed: DLRKNSHQDFWTVWSGNRAS (PRAME_HUMAN)
  Core: NSHQDFWTV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLRKXSHXDXWTXWSGNRAS

SEQ ID NO: 350410 - protein, 20 aa, Artificial Sequence
  Description of Artificial Sequence: Synthetic peptide
  Seed: DLRKNSHQDFWTVWSGNRAS (PRAME_HUMAN)
  Core: HQDFWTVWS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSXQDXWXVWXGNRAS

SEQ ID NO: 350411 - protein, 20 aa, Artificial Sequence
  Description of Artificial Sequence: Synthetic peptide
  Seed: DLRKNSHQDFWTVWSGNRAS (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRAS

SEQ ID NO: 350412 - protein, 20 aa, Artificial Sequence
  Description of Artificial Sequence: Synthetic peptide
  Seed: DLRKNSHQDFWTVWSGNRAS (PRAME_HUMAN)
  Core: FWTVWSGNR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDXWTXWXGNXAS

SEQ ID NO: 350413 - protein, 20 aa, Artificial Sequence
  Description of Artificial Sequence: Synthetic peptide
  Seed: DLRKNSHQDFWTVWSGNRAS (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXS

SEQ ID NO: 350414 - protein, 21 aa, Artificial Sequence
  Description of Artificial Sequence: Synthetic peptide
  Seed: DLRKNSHQDFWTVWSGNRASL (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRASL

SEQ ID NO: 350415 - protein, 21 aa, Artificial Sequence
  Description of Artificial Sequence: Synthetic peptide
  Seed: DLRKNSHQDFWTVWSGNRASL (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXSL

SEQ ID NO: 350416 - protein, 22 aa, Artificial Sequence
  Description of Artificial Sequence: Synthetic peptide
  Seed: DLRKNSHQDFWTVWSGNRASLY (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRASLY

SEQ ID NO: 350417 - protein, 22 aa, Artificial Sequence
  Description of Artificial Sequence: Synthetic peptide
  Seed: DLRKNSHQDFWTVWSGNRASLY (PRAME_HUMAN)
  Core: FWTVWSGNR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDXWTXWXGNXASLY

SEQ ID NO: 350418 - protein, 22 aa, Artificial Sequence
  Description of Artificial Sequence: Synthetic peptide
  Seed: DLRKNSHQDFWTVWSGNRASLY (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXSLY

SEQ ID NO: 350419 - protein, 23 aa, Artificial Sequence
  Description of Artificial Sequence: Synthetic peptide
  Seed: DLRKNSHQDFWTVWSGNRASLYS (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRASLYS

SEQ ID NO: 350420 - protein, 23 aa, Artificial Sequence
  Description of Artificial Sequence: Synthetic peptide
  Seed: DLRKNSHQDFWTVWSGNRASLYS (PRAME_HUMAN)
  Core: FWTVWSGNR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDXWTXWXGNXASLYS

SEQ ID NO: 350421 - protein, 23 aa, Artificial Sequence
  Description of Artificial Sequence: Synthetic peptide
  Seed: DLRKNSHQDFWTVWSGNRASLYS (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXSLYS

SEQ ID NO: 350422 - protein, 23 aa, Artificial Sequence
  Description of Artificial Sequence: Synthetic peptide
  Seed: DLRKNSHQDFWTVWSGNRASLYS (PRAME_HUMAN)
  Core: WSGNRASLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFWTVXSGXRXSLXS

SEQ ID NO: 350423 - protein, 24 aa, Artificial Sequence
  Description of Artificial Sequence: Synthetic peptide
  Seed: DLRKNSHQDFWTVWSGNRASLYSF (PRAME_HUMAN)
  Core: HQDFWTVWS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSXQDXWXVWXGNRASLYSF

SEQ ID NO: 350424 - protein, 24 aa, Artificial Sequence
  Description of Artificial Sequence: Synthetic peptide
  Seed: DLRKNSHQDFWTVWSGNRASLYSF (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRASLYSF

SEQ ID NO: 350425 - protein, 24 aa, Artificial Sequence
  Description of Artificial Sequence: Synthetic peptide
  Seed: DLRKNSHQDFWTVWSGNRASLYSF (PRAME_HUMAN)
  Core: FWTVWSGNR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDXWTXWXGNXASLYSF

SEQ ID NO: 350426 - protein, 24 aa, Artificial Sequence
  Description of Artificial Sequence: Synthetic peptide
  Seed: DLRKNSHQDFWTVWSGNRASLYSF (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXSLYSF

SEQ ID NO: 350427 - protein, 24 aa, Artificial Sequence
  Description of Artificial Sequence: Synthetic peptide
  Seed: DLRKNSHQDFWTVWSGNRASLYSF (PRAME_HUMAN)
  Core: WSGNRASLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFWTVXSGXRXSLXSF

SEQ ID NO: 350428 - protein, 25 aa, Artificial Sequence
  Description of Artificial Sequence: Synthetic peptide
  Seed: DLRKNSHQDFWTVWSGNRASLYSFP (PRAME_HUMAN)
  Core: NSHQDFWTV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DLRKXSHXDXWTXWSGNRASLYSFP

SEQ ID NO: 350429 - protein, 25 aa, Artificial Sequence
  Description of Artificial Sequence: Synthetic peptide
  Seed: DLRKNSHQDFWTVWSGNRASLYSFP (PRAME_HUMAN)
  Core: QDFWTVWSG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHXDFXTXWSXNRASLYSFP

SEQ ID NO: 350430 - protein, 25 aa, Artificial Sequence
  Description of Artificial Sequence: Synthetic peptide
  Seed: DLRKNSHQDFWTVWSGNRASLYSFP (PRAME_HUMAN)
  Core: WTVWSGNRA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFXTVXSXNRXSLYSFP

SEQ ID NO: 350431 - protein, 25 aa, Artificial Sequence
  Description of Artificial Sequence: Synthetic peptide
  Seed: DLRKNSHQDFWTVWSGNRASLYSFP (PRAME_HUMAN)
  Core: WSGNRASLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLRKNSHQDFWTVXSGXRXSLXSFP

SEQ ID NO: 350432 - protein, 17 aa, Artificial Sequence
  Description of Artificial Sequence: Synthetic peptide
  Seed: DLVFDECGITDDQLLAL (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLAL

SEQ ID NO: 350433 - protein, 17 aa, Artificial Sequence
  Description of Artificial Sequence: Synthetic peptide
  Seed: DLVFDECGITDDQLLAL (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAX

SEQ ID NO: 350434 - protein, 19 aa, Artificial Sequence
  Description of Artificial Sequence: Synthetic peptide
  Seed: DLVFDECGITDDQLLALLP (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLP

SEQ ID NO: 350435 - protein, 19 aa, Artificial Sequence
  Description of Artificial Sequence: Synthetic peptide
  Seed: DLVFDECGITDDQLLALLP (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLP

SEQ ID NO: 350436 - protein, 20 aa, Artificial Sequence
  Description of Artificial Sequence: Synthetic peptide
  Seed: DLVFDECGITDDQLLALLPS (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPS

SEQ ID NO: 350437 - protein, 20 aa, Artificial Sequence
  Description of Artificial Sequence: Synthetic peptide
  Seed: DLVFDECGITDDQLLALLPS (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPS

SEQ ID NO: 350438 - protein, 21 aa, Artificial Sequence
  Description of Artificial Sequence: Synthetic peptide
  Seed: DLVFDECGITDDQLLALLPSL (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPSL

SEQ ID NO: 350439 - protein, 21 aa, Artificial Sequence
  Description of Artificial Sequence: Synthetic peptide
  Seed: DLVFDECGITDDQLLALLPSL (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPSL

SEQ ID NO: 350440 - protein, 22 aa, Artificial Sequence
  Description of Artificial Sequence: Synthetic peptide
  Seed: DLVFDECGITDDQLLALLPSLS (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPSLS

SEQ ID NO: 350441 - protein, 22 aa, Artificial Sequence
  Description of Artificial Sequence: Synthetic peptide
  Seed: DLVFDECGITDDQLLALLPSLS (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPSLS

SEQ ID NO: 350442 - protein, 22 aa, Artificial Sequence
  Description of Artificial Sequence: Synthetic peptide
  Seed: DLVFDECGITDDQLLALLPSLS (PRAME_HUMAN)
  Core: LLALLPSLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQXLAXLXSLX

SEQ ID NO: 350443 - protein, 23 aa, Artificial Sequence
  Description of Artificial Sequence: Synthetic peptide
  Seed: DLVFDECGITDDQLLALLPSLSH (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPSLSH

SEQ ID NO: 350444 - protein, 23 aa, Artificial Sequence
  Description of Artificial Sequence: Synthetic peptide
  Seed: DLVFDECGITDDQLLALLPSLSH (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPSLSH

SEQ ID NO: 350445 - protein, 23 aa, Artificial Sequence
  Description of Artificial Sequence: Synthetic peptide
  Seed: DLVFDECGITDDQLLALLPSLSH (PRAME_HUMAN)
  Core: DQLLALLPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDXQLXAXLPXLSH

SEQ ID NO: 350446 - protein, 23 aa, Artificial Sequence
  Description of Artificial Sequence: Synthetic peptide
  Seed: DLVFDECGITDDQLLALLPSLSH (PRAME_HUMAN)
  Core: LLALLPSLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQXLAXLXSLXH

SEQ ID NO: 350447 - protein, 24 aa, Artificial Sequence
  Description of Artificial Sequence: Synthetic peptide
  Seed: DLVFDECGITDDQLLALLPSLSHC (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPSLSHC

SEQ ID NO: 350448 - protein, 24 aa, Artificial Sequence
  Description of Artificial Sequence: Synthetic peptide
  Seed: DLVFDECGITDDQLLALLPSLSHC (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPSLSHC

SEQ ID NO: 350449 - protein, 24 aa, Artificial Sequence
  Description of Artificial Sequence: Synthetic peptide
  Seed: DLVFDECGITDDQLLALLPSLSHC (PRAME_HUMAN)
  Core: DQLLALLPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDXQLXAXLPXLSHC

SEQ ID NO: 350450 - protein, 24 aa, Artificial Sequence
  Description of Artificial Sequence: Synthetic peptide
  Seed: DLVFDECGITDDQLLALLPSLSHC (PRAME_HUMAN)
  Core: LLALLPSLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQXLAXLXSLXHC

SEQ ID NO: 350451 - protein, 24 aa, Artificial Sequence
  Description of Artificial Sequence: Synthetic peptide
  Seed: DLVFDECGITDDQLLALLPSLSHC (PRAME_HUMAN)
  Core: LALLPSLSH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQLXALXPXLSXC

SEQ ID NO: 350452 - protein, 25 aa, Artificial Sequence
  Description of Artificial Sequence: Synthetic peptide
  Seed: DLVFDECGITDDQLLALLPSLSHCS (PRAME_HUMAN)
  Core: ECGITDDQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDXCGXTXDQXLALLPSLSHCS

SEQ ID NO: 350453 - protein, 25 aa, Artificial Sequence
  Description of Artificial Sequence: Synthetic peptide
  Seed: DLVFDECGITDDQLLALLPSLSHCS (PRAME_HUMAN)
  Core: ITDDQLLAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGXTDXQXLAXLPSLSHCS

SEQ ID NO: 350454 - protein, 25 aa, Artificial Sequence
  Description of Artificial Sequence: Synthetic peptide
  Seed: DLVFDECGITDDQLLALLPSLSHCS (PRAME_HUMAN)
  Core: DQLLALLPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDXQLXAXLPXLSHCS

SEQ ID NO: 350455 - protein, 25 aa, Artificial Sequence
  Description of Artificial Sequence: Synthetic peptide
  Seed: DLVFDECGITDDQLLALLPSLSHCS (PRAME_HUMAN)
  Core: LLALLPSLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQXLAXLXSLXHCS

SEQ ID NO: 350456 - protein, 25 aa, Artificial Sequence
  Description of Artificial Sequence: Synthetic peptide
  Seed: DLVFDECGITDDQLLALLPSLSHCS (PRAME_HUMAN)
  Core: LALLPSLSH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DLVFDECGITDDQLXALXPXLSXCS

SEQ ID NO: 350457 - protein, 13 aa, Artificial Sequence
  Description of Artificial Sequence: Synthetic peptide
  Seed: DQLLALLPSLSHC (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHC

SEQ ID NO: 350458 - protein, 13 aa, Artificial Sequence
  Description of Artificial Sequence: Synthetic peptide
  Seed: DQLLALLPSLSHC (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXC

SEQ ID NO: 350459 - protein, 14 aa, Artificial Sequence
  Description of Artificial Sequence: Synthetic peptide
  Seed: DQLLALLPSLSHCS (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCS

SEQ ID NO: 350460 - protein, 14 aa, Artificial Sequence
  Description of Artificial Sequence: Synthetic peptide
  Seed: DQLLALLPSLSHCS (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCS

SEQ ID NO: 350461 - protein, 15 aa, Artificial Sequence
  Description of Artificial Sequence: Synthetic peptide
  Seed: DQLLALLPSLSHCSQ (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQ

SEQ ID NO: 350462 - protein, 15 aa, Artificial Sequence
  Description of Artificial Sequence: Synthetic peptide
  Seed: DQLLALLPSLSHCSQ (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQ

SEQ ID NO: 350463 - protein, 15 aa, Artificial Sequence
  Description of Artificial Sequence: Synthetic peptide
  Seed: DQLLALLPSLSHCSQ (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQ

SEQ ID NO: 350464 - protein, 16 aa, Artificial Sequence
  Description of Artificial Sequence: Synthetic peptide
  Seed: DQLLALLPSLSHCSQL (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQL

SEQ ID NO: 350465 - protein, 16 aa, Artificial Sequence
  Description of Artificial Sequence: Synthetic peptide
  Seed: DQLLALLPSLSHCSQL (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQL

SEQ ID NO: 350466 - protein, 16 aa, Artificial Sequence
  Description of Artificial Sequence: Synthetic peptide
  Seed: DQLLALLPSLSHCSQL (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQL

SEQ ID NO: 350467 - protein, 17 aa, Artificial Sequence
  Description of Artificial Sequence: Synthetic peptide
  Seed: DQLLALLPSLSHCSQLT (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLT

SEQ ID NO: 350468 - protein, 17 aa, Artificial Sequence
  Description of Artificial Sequence: Synthetic peptide
  Seed: DQLLALLPSLSHCSQLT (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLT

SEQ ID NO: 350469 - protein, 17 aa, Artificial Sequence
  Description of Artificial Sequence: Synthetic peptide
  Seed: DQLLALLPSLSHCSQLT (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLT

SEQ ID NO: 350470 - protein, 18 aa, Artificial Sequence
  Description of Artificial Sequence: Synthetic peptide
  Seed: DQLLALLPSLSHCSQLTT (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTT

SEQ ID NO: 350471 - protein, 18 aa, Artificial Sequence
  Description of Artificial Sequence: Synthetic peptide
  Seed: DQLLALLPSLSHCSQLTT (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTT

SEQ ID NO: 350472 - protein, 18 aa, Artificial Sequence
  Description of Artificial Sequence: Synthetic peptide
  Seed: DQLLALLPSLSHCSQLTT (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTT

SEQ ID NO: 350473 - protein, 19 aa, Artificial Sequence
  Description of Artificial Sequence: Synthetic peptide
  Seed: DQLLALLPSLSHCSQLTTL (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTL

SEQ ID NO: 350474 - protein, 19 aa, Artificial Sequence
  Description of Artificial Sequence: Synthetic peptide
  Seed: DQLLALLPSLSHCSQLTTL (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTL

SEQ ID NO: 350475 - protein, 19 aa, Artificial Sequence
  Description of Artificial Sequence: Synthetic peptide
  Seed: DQLLALLPSLSHCSQLTTL (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTL

SEQ ID NO: 350476 - protein, 20 aa, Artificial Sequence
  Description of Artificial Sequence: Synthetic peptide
  Seed: DQLLALLPSLSHCSQLTTLS (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLS

SEQ ID NO: 350477 - protein, 20 aa, Artificial Sequence
  Description of Artificial Sequence: Synthetic peptide
  Seed: DQLLALLPSLSHCSQLTTLS (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLS

SEQ ID NO: 350478 - protein, 20 aa, Artificial Sequence
  Description of Artificial Sequence: Synthetic peptide
  Seed: DQLLALLPSLSHCSQLTTLS (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLS

SEQ ID NO: 350479 - protein, 21 aa, Artificial Sequence
  Description of Artificial Sequence: Synthetic peptide
  Seed: DQLLALLPSLSHCSQLTTLSF (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLSF

SEQ ID NO: 350480 - protein, 21 aa, Artificial Sequence
  Description of Artificial Sequence: Synthetic peptide
  Seed: DQLLALLPSLSHCSQLTTLSF (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLSF

SEQ ID NO: 350481 - protein, 21 aa, Artificial Sequence
  Description of Artificial Sequence: Synthetic peptide
  Seed: DQLLALLPSLSHCSQLTTLSF (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLSF

SEQ ID NO: 350482 - protein, 22 aa, Artificial Sequence
  Description of Artificial Sequence: Synthetic peptide
  Seed: DQLLALLPSLSHCSQLTTLSFY (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLSFY

SEQ ID NO: 350483 - protein, 22 aa, Artificial Sequence
  Description of Artificial Sequence: Synthetic peptide
  Seed: DQLLALLPSLSHCSQLTTLSFY (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLSFY

SEQ ID NO: 350484 - protein, 22 aa, Artificial Sequence
  Description of Artificial Sequence: Synthetic peptide
  Seed: DQLLALLPSLSHCSQLTTLSFY (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLSFY

SEQ ID NO: 350485 - protein, 22 aa, Artificial Sequence
  Description of Artificial Sequence: Synthetic peptide
  Seed: DQLLALLPSLSHCSQLTTLSFY (PRAME_HUMAN)
  Core: SHCSQLTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLXHCXQXTTXSFY

SEQ ID NO: 350486 - protein, 23 aa, Artificial Sequence
  Description of Artificial Sequence: Synthetic peptide
  Seed: DQLLALLPSLSHCSQLTTLSFYG (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLSFYG

SEQ ID NO: 350487 - protein, 23 aa, Artificial Sequence
  Description of Artificial Sequence: Synthetic peptide
  Seed: DQLLALLPSLSHCSQLTTLSFYG (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLSFYG

SEQ ID NO: 350488 - protein, 23 aa, Artificial Sequence
  Description of Artificial Sequence: Synthetic peptide
  Seed: DQLLALLPSLSHCSQLTTLSFYG (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLSFYG

SEQ ID NO: 350489 - protein, 23 aa, Artificial Sequence
  Description of Artificial Sequence: Synthetic peptide
  Seed: DQLLALLPSLSHCSQLTTLSFYG (PRAME_HUMAN)
  Core: SHCSQLTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLXHCXQXTTXSFYG

SEQ ID NO: 350490 - protein, 24 aa, Artificial Sequence
  Description of Artificial Sequence: Synthetic peptide
  Seed: DQLLALLPSLSHCSQLTTLSFYGN (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLSFYGN

SEQ ID NO: 350491 - protein, 24 aa, Artificial Sequence
  Description of Artificial Sequence: Synthetic peptide
  Seed: DQLLALLPSLSHCSQLTTLSFYGN (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLSFYGN

SEQ ID NO: 350492 - protein, 24 aa, Artificial Sequence
  Description of Artificial Sequence: Synthetic peptide
  Seed: DQLLALLPSLSHCSQLTTLSFYGN (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLSFYGN

SEQ ID NO: 350493 - protein, 24 aa, Artificial Sequence
  Description of Artificial Sequence: Synthetic peptide
  Seed: DQLLALLPSLSHCSQLTTLSFYGN (PRAME_HUMAN)
  Core: SHCSQLTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLXHCXQXTTXSFYGN

SEQ ID NO: 350494 - protein, 24 aa, Artificial Sequence
  Description of Artificial Sequence: Synthetic peptide
  Seed: DQLLALLPSLSHCSQLTTLSFYGN (PRAME_HUMAN)
  Core: QLTTLSFYG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLSHCSXLTXLXFYXN

SEQ ID NO: 350495 - protein, 24 aa, Artificial Sequence
  Description of Artificial Sequence: Synthetic peptide
  Seed: DQLLALLPSLSHCSQLTTLSFYGN (PRAME_HUMAN)
  Core: LTTLSFYGN
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLSHCSQXTTXSXYGX

SEQ ID NO: 350496 - protein, 25 aa, Artificial Sequence
  Description of Artificial Sequence: Synthetic peptide
  Seed: DQLLALLPSLSHCSQLTTLSFYGNS (PRAME_HUMAN)
  Core: LLALLPSLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLAXLXSLXHCSQLTTLSFYGNS

SEQ ID NO: 350497 - protein, 25 aa, Artificial Sequence
  Description of Artificial Sequence: Synthetic peptide
  Seed: DQLLALLPSLSHCSQLTTLSFYGNS (PRAME_HUMAN)
  Core: LALLPSLSH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXALXPXLSXCSQLTTLSFYGNS

SEQ ID NO: 350498 - protein, 25 aa, Artificial Sequence
  Description of Artificial Sequence: Synthetic peptide
  Seed: DQLLALLPSLSHCSQLTTLSFYGNS (PRAME_HUMAN)
  Core: LLPSLSHCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLAXLPXLXHCXQLTTLSFYGNS

SEQ ID NO: 350499 - protein, 25 aa, Artificial Sequence
  Description of Artificial Sequence: Synthetic peptide
  Seed: DQLLALLPSLSHCSQLTTLSFYGNS (PRAME_HUMAN)
  Core: SHCSQLTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLXHCXQXTTXSFYGNS

SEQ ID NO: 350500 - protein, 25 aa, Artificial Sequence
  Description of Artificial Sequence: Synthetic peptide
  Seed: DQLLALLPSLSHCSQLTTLSFYGNS (PRAME_HUMAN)
  Core: QLTTLSFYG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLSHCSXLTXLXFYXNS

SEQ ID NO: 350501 - protein, 25 aa, Artificial Sequence
  Description of Artificial Sequence: Synthetic peptide
  Seed: DQLLALLPSLSHCSQLTTLSFYGNS (PRAME_HUMAN)
  Core: LTTLSFYGN
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DQLLALLPSLSHCSQXTTXSXYGXS

SEQ ID NO: 350502 - protein, 13 aa, Artificial Sequence
  Description of Artificial Sequence: Synthetic peptide
  Seed: DQLLRHVMNPLET (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXET

SEQ ID NO: 350503 - protein, 13 aa, Artificial Sequence
  Description of Artificial Sequence: Synthetic peptide
  Seed: DQLLRHVMNPLET (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXT

SEQ ID NO: 350504 - protein, 14 aa, Artificial Sequence
  Description of Artificial Sequence: Synthetic peptide
  Seed: DQLLRHVMNPLETL (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETL

SEQ ID NO: 350505 - protein, 14 aa, Artificial Sequence
  Description of Artificial Sequence: Synthetic peptide
  Seed: DQLLRHVMNPLETL (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTL

SEQ ID NO: 350506 - protein, 14 aa, Artificial Sequence
  Description of Artificial Sequence: Synthetic peptide
  Seed: DQLLRHVMNPLETL (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXL

SEQ ID NO: 350507 - protein, 15 aa, Artificial Sequence
  Description of Artificial Sequence: Synthetic peptide
  Seed: DQLLRHVMNPLETLS (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLS

SEQ ID NO: 350508 - protein, 15 aa, Artificial Sequence
  Description of Artificial Sequence: Synthetic peptide
  Seed: DQLLRHVMNPLETLS (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLS

SEQ ID NO: 350509 - protein, 15 aa, Artificial Sequence
  Description of Artificial Sequence: Synthetic peptide
  Seed: DQLLRHVMNPLETLS (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLS

SEQ ID NO: 350510 - protein, 16 aa, Artificial Sequence
  Description of Artificial Sequence: Synthetic peptide
  Seed: DQLLRHVMNPLETLSI (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSI

SEQ ID NO: 350511 - protein, 16 aa, Artificial Sequence
  Description of Artificial Sequence: Synthetic peptide
  Seed: DQLLRHVMNPLETLSI (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSI

SEQ ID NO: 350512 - protein, 16 aa, Artificial Sequence
  Description of Artificial Sequence: Synthetic peptide
  Seed: DQLLRHVMNPLETLSI (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSI

SEQ ID NO: 350513 - protein, 16 aa, Artificial Sequence
  Description of Artificial Sequence: Synthetic peptide
  Seed: DQLLRHVMNPLETLSI (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSI

SEQ ID NO: 350514 - protein, 17 aa, Artificial Sequence
  Description of Artificial Sequence: Synthetic peptide
  Seed: DQLLRHVMNPLETLSIT (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSIT

SEQ ID NO: 350515 - protein, 17 aa, Artificial Sequence
  Description of Artificial Sequence: Synthetic peptide
  Seed: DQLLRHVMNPLETLSIT (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSIT

SEQ ID NO: 350516 - protein, 17 aa, Artificial Sequence
  Description of Artificial Sequence: Synthetic peptide
  Seed: DQLLRHVMNPLETLSIT (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSIT

SEQ ID NO: 350517 - protein, 17 aa, Artificial Sequence
  Description of Artificial Sequence: Synthetic peptide
  Seed: DQLLRHVMNPLETLSIT (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSIT

SEQ ID NO: 350518 - protein, 17 aa, Artificial Sequence
  Description of Artificial Sequence: Synthetic peptide
  Seed: DQLLRHVMNPLETLSIT (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXT

SEQ ID NO: 350519 - protein, 18 aa, Artificial Sequence
  Description of Artificial Sequence: Synthetic peptide
  Seed: DQLLRHVMNPLETLSITN (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITN

SEQ ID NO: 350520 - protein, 18 aa, Artificial Sequence
  Description of Artificial Sequence: Synthetic peptide
  Seed: DQLLRHVMNPLETLSITN (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITN

SEQ ID NO: 350521 - protein, 18 aa, Artificial Sequence
  Description of Artificial Sequence: Synthetic peptide
  Seed: DQLLRHVMNPLETLSITN (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITN

SEQ ID NO: 350522 - protein, 18 aa, Artificial Sequence
  Description of Artificial Sequence: Synthetic peptide
  Seed: DQLLRHVMNPLETLSITN (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITN

SEQ ID NO: 350523 - protein, 18 aa, Artificial Sequence
  Description of Artificial Sequence: Synthetic peptide
  Seed: DQLLRHVMNPLETLSITN (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTN

SEQ ID NO: 350524 - protein, 19 aa, Artificial Sequence
  Description of Artificial Sequence: Synthetic peptide
  Seed: DQLLRHVMNPLETLSITNC (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNC

SEQ ID NO: 350525 - protein, 19 aa, Artificial Sequence
  Description of Artificial Sequence: Synthetic peptide
  Seed: DQLLRHVMNPLETLSITNC (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNC

SEQ ID NO: 350526 - protein, 19 aa, Artificial Sequence
  Description of Artificial Sequence: Synthetic peptide
  Seed: DQLLRHVMNPLETLSITNC (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNC

SEQ ID NO: 350527 - protein, 19 aa, Artificial Sequence
  Description of Artificial Sequence: Synthetic peptide
  Seed: DQLLRHVMNPLETLSITNC (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNC

SEQ ID NO: 350528 - protein, 19 aa, Artificial Sequence
  Description of Artificial Sequence: Synthetic peptide
  Seed: DQLLRHVMNPLETLSITNC (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNC

SEQ ID NO: 350529 - protein, 20 aa, Artificial Sequence
  Description of Artificial Sequence: Synthetic peptide
  Seed: DQLLRHVMNPLETLSITNCR (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCR

SEQ ID NO: 350530 - protein, 20 aa, Artificial Sequence
  Description of Artificial Sequence: Synthetic peptide
  Seed: DQLLRHVMNPLETLSITNCR (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCR

SEQ ID NO: 350531 - protein, 20 aa, Artificial Sequence
  Description of Artificial Sequence: Synthetic peptide
  Seed: DQLLRHVMNPLETLSITNCR (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCR

SEQ ID NO: 350532 - protein, 20 aa, Artificial Sequence
  Description of Artificial Sequence: Synthetic peptide
  Seed: DQLLRHVMNPLETLSITNCR (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCR

SEQ ID NO: 350533 - protein, 20 aa, Artificial Sequence
  Description of Artificial Sequence: Synthetic peptide
  Seed: DQLLRHVMNPLETLSITNCR (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCR

SEQ ID NO: 350534 - protein, 21 aa, Artificial Sequence
  Description of Artificial Sequence: Synthetic peptide
  Seed: DQLLRHVMNPLETLSITNCRL (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCRL

SEQ ID NO: 350535 - protein, 21 aa, Artificial Sequence
  Description of Artificial Sequence: Synthetic peptide
  Seed: DQLLRHVMNPLETLSITNCRL (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCRL

SEQ ID NO: 350536 - protein, 21 aa, Artificial Sequence
  Description of Artificial Sequence: Synthetic peptide
  Seed: DQLLRHVMNPLETLSITNCRL (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCRL

SEQ ID NO: 350537 - protein, 21 aa, Artificial Sequence
  Description of Artificial Sequence: Synthetic peptide
  Seed: DQLLRHVMNPLETLSITNCRL (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCRL

SEQ ID NO: 350538 - protein, 21 aa, Artificial Sequence
  Description of Artificial Sequence: Synthetic peptide
  Seed: DQLLRHVMNPLETLSITNCRL (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCRL

SEQ ID NO: 350539 - protein, 22 aa, Artificial Sequence
  Description of Artificial Sequence: Synthetic peptide
  Seed: DQLLRHVMNPLETLSITNCRLS (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCRLS

SEQ ID NO: 350540 - protein, 22 aa, Artificial Sequence
  Description of Artificial Sequence: Synthetic peptide
  Seed: DQLLRHVMNPLETLSITNCRLS (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCRLS

SEQ ID NO: 350541 - protein, 22 aa, Artificial Sequence
  Description of Artificial Sequence: Synthetic peptide
  Seed: DQLLRHVMNPLETLSITNCRLS (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCRLS

SEQ ID NO: 350542 - protein, 22 aa, Artificial Sequence
  Description of Artificial Sequence: Synthetic peptide
  Seed: DQLLRHVMNPLETLSITNCRLS (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCRLS

SEQ ID NO: 350543 - protein, 22 aa, Artificial Sequence
  Description of Artificial Sequence: Synthetic peptide
  Seed: DQLLRHVMNPLETLSITNCRLS (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCRLS

SEQ ID NO: 350544 - protein, 22 aa, Artificial Sequence
  Description of Artificial Sequence: Synthetic peptide
  Seed: DQLLRHVMNPLETLSITNCRLS (PRAME_HUMAN)
  Core: LETLSITNC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPXETXSXTNXRLS

SEQ ID NO: 350545 - protein, 23 aa, Artificial Sequence
  Description of Artificial Sequence: Synthetic peptide
  Seed: DQLLRHVMNPLETLSITNCRLSE (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCRLSE

SEQ ID NO: 350546 - protein, 23 aa, Artificial Sequence
  Description of Artificial Sequence: Synthetic peptide
  Seed: DQLLRHVMNPLETLSITNCRLSE (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCRLSE

SEQ ID NO: 350547 - protein, 23 aa, Artificial Sequence
  Description of Artificial Sequence: Synthetic peptide
  Seed: DQLLRHVMNPLETLSITNCRLSE (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCRLSE

SEQ ID NO: 350548 - protein, 23 aa, Artificial Sequence
  Description of Artificial Sequence: Synthetic peptide
  Seed: DQLLRHVMNPLETLSITNCRLSE (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCRLSE

SEQ ID NO: 350549 - protein, 23 aa, Artificial Sequence
  Description of Artificial Sequence: Synthetic peptide
  Seed: DQLLRHVMNPLETLSITNCRLSE (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCRLSE

SEQ ID NO: 350550 - protein, 23 aa, Artificial Sequence
  Description of Artificial Sequence: Synthetic peptide
  Seed: DQLLRHVMNPLETLSITNCRLSE (PRAME_HUMAN)
  Core: LETLSITNC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPXETXSXTNXRLSE

SEQ ID NO: 350551 - protein, 24 aa, Artificial Sequence
  Description of Artificial Sequence: Synthetic peptide
  Seed: DQLLRHVMNPLETLSITNCRLSEG (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCRLSEG

SEQ ID NO: 350552 - protein, 24 aa, Artificial Sequence
  Description of Artificial Sequence: Synthetic peptide
  Seed: DQLLRHVMNPLETLSITNCRLSEG (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCRLSEG

SEQ ID NO: 350553 - protein, 24 aa, Artificial Sequence
  Description of Artificial Sequence: Synthetic peptide
  Seed: DQLLRHVMNPLETLSITNCRLSEG (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCRLSEG

SEQ ID NO: 350554 - protein, 24 aa, Artificial Sequence
  Description of Artificial Sequence: Synthetic peptide
  Seed: DQLLRHVMNPLETLSITNCRLSEG (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCRLSEG

SEQ ID NO: 350555 - protein, 24 aa, Artificial Sequence
  Description of Artificial Sequence: Synthetic peptide
  Seed: DQLLRHVMNPLETLSITNCRLSEG (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCRLSEG

SEQ ID NO: 350556 - protein, 24 aa, Artificial Sequence
  Description of Artificial Sequence: Synthetic peptide
  Seed: DQLLRHVMNPLETLSITNCRLSEG (PRAME_HUMAN)
  Core: LETLSITNC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPXETXSXTNXRLSEG

SEQ ID NO: 350557 - protein, 24 aa, Artificial Sequence
  Description of Artificial Sequence: Synthetic peptide
  Seed: DQLLRHVMNPLETLSITNCRLSEG (PRAME_HUMAN)
  Core: TLSITNCRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPLEXLSXTXCRXSEG

SEQ ID NO: 350558 - protein, 24 aa, Artificial Sequence
  Description of Artificial Sequence: Synthetic peptide
  Seed: DQLLRHVMNPLETLSITNCRLSEG (PRAME_HUMAN)
  Core: LSITNCRLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPLETXSIXNXRLXEG

SEQ ID NO: 350559 - protein, 25 aa, Artificial Sequence
  Description of Artificial Sequence: Synthetic peptide
  Seed: DQLLRHVMNPLETLSITNCRLSEGD (PRAME_HUMAN)
  Core: LLRHVMNPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DQXLRXVXNPXETLSITNCRLSEGD

SEQ ID NO: 350560 - protein, 25 aa, Artificial Sequence
  Description of Artificial Sequence: Synthetic peptide
  Seed: DQLLRHVMNPLETLSITNCRLSEGD (PRAME_HUMAN)
  Core: LRHVMNPLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DQLXRHXMXPLXTLSITNCRLSEGD

SEQ ID NO: 350561 - protein, 25 aa, Artificial Sequence
  Description of Artificial Sequence: Synthetic peptide
  Seed: DQLLRHVMNPLETLSITNCRLSEGD (PRAME_HUMAN)
  Core: RHVMNPLET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DQLLXHVXNXLEXLSITNCRLSEGD

SEQ ID NO: 350562 - protein, 25 aa, Artificial Sequence
  Description of Artificial Sequence: Synthetic peptide
  Seed: DQLLRHVMNPLETLSITNCRLSEGD (PRAME_HUMAN)
  Core: HVMNPLETL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRXVMXPXETXSITNCRLSEGD

SEQ ID NO: 350563 - protein, 25 aa, Artificial Sequence
  Description of Artificial Sequence: Synthetic peptide
  Seed: DQLLRHVMNPLETLSITNCRLSEGD (PRAME_HUMAN)
  Core: MNPLETLSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVXNPXEXLSXTNCRLSEGD

SEQ ID NO: 350564 - protein, 25 aa, Artificial Sequence
  Description of Artificial Sequence: Synthetic peptide
  Seed: DQLLRHVMNPLETLSITNCRLSEGD (PRAME_HUMAN)
  Core: LETLSITNC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPXETXSXTNXRLSEGD

SEQ ID NO: 350565 - protein, 25 aa, Artificial Sequence
  Description of Artificial Sequence: Synthetic peptide
  Seed: DQLLRHVMNPLETLSITNCRLSEGD (PRAME_HUMAN)
  Core: LSITNCRLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DQLLRHVMNPLETXSIXNXRLXEGD

SEQ ID NO: 350566 - protein, 14 aa, Artificial Sequence
  Description of Artificial Sequence: Synthetic peptide
  Seed: DSIEDLEVTCTWKL (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKX

SEQ ID NO: 350567 - protein, 15 aa, Artificial Sequence
  Description of Artificial Sequence: Synthetic peptide
  Seed: DSIEDLEVTCTWKLP (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXP

SEQ ID NO: 350568 - protein, 16 aa, Artificial Sequence
  Description of Artificial Sequence: Synthetic peptide
  Seed: DSIEDLEVTCTWKLPT (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPT

SEQ ID NO: 350569 - protein, 17 aa, Artificial Sequence
  Description of Artificial Sequence: Synthetic peptide
  Seed: DSIEDLEVTCTWKLPTL (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPTL

SEQ ID NO: 350570 - protein, 19 aa, Artificial Sequence
  Description of Artificial Sequence: Synthetic peptide
  Seed: DSIEDLEVTCTWKLPTLAK (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPTLAK

SEQ ID NO: 350571 - protein, 19 aa, Artificial Sequence
  Description of Artificial Sequence: Synthetic peptide
  Seed: DSIEDLEVTCTWKLPTLAK (PRAME_HUMAN)
  Core: VTCTWKLPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEXTCXWXLPXLAK

SEQ ID NO: 350572 - protein, 20 aa, Artificial Sequence
  Description of Artificial Sequence: Synthetic peptide
  Seed: DSIEDLEVTCTWKLPTLAKF (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPTLAKF

SEQ ID NO: 350573 - protein, 20 aa, Artificial Sequence
  Description of Artificial Sequence: Synthetic peptide
  Seed: DSIEDLEVTCTWKLPTLAKF (PRAME_HUMAN)
  Core: VTCTWKLPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEXTCXWXLPXLAKF

SEQ ID NO: 350574 - protein, 20 aa, Artificial Sequence
  Description of Artificial Sequence: Synthetic peptide
  Seed: DSIEDLEVTCTWKLPTLAKF (PRAME_HUMAN)
  Core: TCTWKLPTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEVXCTXKXPTXAKF

SEQ ID NO: 350575 - protein, 20 aa, Artificial Sequence
  Description of Artificial Sequence: Synthetic peptide
  Seed: DSIEDLEVTCTWKLPTLAKF (PRAME_HUMAN)
  Core: CTWKLPTLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEVTXTWXLXTLXKF

SEQ ID NO: 350576 - protein, 21 aa, Artificial Sequence
  Description of Artificial Sequence: Synthetic peptide
  Seed: DSIEDLEVTCTWKLPTLAKFS (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPTLAKFS

SEQ ID NO: 350577 - protein, 21 aa, Artificial Sequence
  Description of Artificial Sequence: Synthetic peptide
  Seed: DSIEDLEVTCTWKLPTLAKFS (PRAME_HUMAN)
  Core: VTCTWKLPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEXTCXWXLPXLAKFS

SEQ ID NO: 350578 - protein, 21 aa, Artificial Sequence
  Description of Artificial Sequence: Synthetic peptide
  Seed: DSIEDLEVTCTWKLPTLAKFS (PRAME_HUMAN)
  Core: CTWKLPTLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEVTXTWXLXTLXKFS

SEQ ID NO: 350579 - protein, 22 aa, Artificial Sequence
  Description of Artificial Sequence: Synthetic peptide
  Seed: DSIEDLEVTCTWKLPTLAKFSP (PRAME_HUMAN)
  Core: LEVTCTWKL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDXEVXCXWKXPTLAKFSP

SEQ ID NO: 350580 - protein, 22 aa, Artificial Sequence
  Description of Artificial Sequence: Synthetic peptide
  Seed: DSIEDLEVTCTWKLPTLAKFSP (PRAME_HUMAN)
  Core: VTCTWKLPT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEXTCXWXLPXLAKFSP

SEQ ID NO: 350581 - protein, 22 aa, Artificial Sequence
  Description of Artificial Sequence: Synthetic peptide
  Seed: DSIEDLEVTCTWKLPTLAKFSP (PRAME_HUMAN)
  Core: CTWKLPTLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEVTXTWXLXTLXKFSP

SEQ ID NO: 350582 - protein, 22 aa, Artificial Sequence
  Description of Artificial Sequence: Synthetic peptide
  Seed: DSIEDLEVTCTWKLPTLAKFSP (PRAME_HUMAN)
  Core: WKLPTLAKF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSIEDLEVTCTXKLXTXAKXSP
